United States Patent
Cabirol et al.

(10) Patent No.: US 9,109,209 B2
(45) Date of Patent: Aug. 18, 2015

(54) BIOCATALYSTS AND METHODS FOR THE SYNTHESIS OF SUBSTITUTED LACTAMS

(75) Inventors: Fabien Cabirol, Dusseldorf (DE); Haibin Chen, Beijing (CN); Anupam Gohel, Singapore (SG); Paulina Salim, Singapore (SG); Derek Smith, Singapore (SG); Jacob Janey, New York, NY (US); Birgit Kosjek, Westfield, NJ (US); Weng Lin Tang, Singapore (SG); Helen Hsieh, Singapore (SG); Son Pham, Singapore (SG)

(73) Assignee: Codexis, Inc., Redwood City, CA (US)

( * ) Notice: Subject to any disclaimer, the term of this patent is extended or adjusted under 35 U.S.C. 154(b) by 0 days.

(21) Appl. No.: 14/342,713

(22) PCT Filed: Sep. 7, 2012

(86) PCT No.: PCT/US2012/054300
§ 371 (c)(1),
(2), (4) Date: Mar. 4, 2014

(87) PCT Pub. No.: WO2013/036861
PCT Pub. Date: Mar. 14, 2013

(65) Prior Publication Data
US 2014/0342412 A1 Nov. 20, 2014

Related U.S. Application Data

(60) Provisional application No. 61/532,259, filed on Sep. 8, 2011.

(51) Int. Cl.
C12N 9/10 (2006.01)
C07D 211/76 (2006.01)
C12P 13/00 (2006.01)
C12P 17/12 (2006.01)

(52) U.S. Cl.
CPC ............ *C12N 9/1096* (2013.01); *C07D 211/76* (2013.01); *C12P 13/001* (2013.01); *C12P 13/005* (2013.01); *C12P 17/12* (2013.01); *C12Y 206/01* (2013.01)

(58) Field of Classification Search
None
See application file for complete search history.

(56) References Cited

U.S. PATENT DOCUMENTS

| | | | |
|---|---|---|---|
| 4,870,173 | A | 9/1989 | Minaskanian et al. |
| 6,117,679 | A | 9/2000 | Stemmer |
| 6,150,535 | A | 11/2000 | Awaji et al. |
| 6,376,246 | B1 | 4/2002 | Crameri et al. |
| 6,537,746 | B2 | 3/2003 | Arnold et al. |
| 6,586,182 | B1 | 7/2003 | Patten et al. |
| 6,770,658 | B2 | 8/2004 | Shen et al. |
| 6,852,713 | B2 | 2/2005 | Dolle et al. |
| 7,169,592 | B2 | 1/2007 | Yamada et al. |
| 7,276,531 | B2 | 10/2007 | Araldi et al. |
| 7,378,410 | B2 | 5/2008 | Bair et al. |
| 7,618,799 | B2 | 11/2009 | Coleman et al. |
| 2006/0195947 | A1 | 8/2006 | Davis et al. |
| 2007/0149777 | A1 | 6/2007 | Frost |
| 2008/0213845 | A1 | 9/2008 | Fotheringham et al. |
| 2008/0220990 | A1 | 9/2008 | Fox |
| 2009/0312196 | A1 | 12/2009 | Colbeck et al. |
| 2010/0285541 | A1 | 11/2010 | Saville et al. |

FOREIGN PATENT DOCUMENTS

| | | |
|---|---|---|
| WO | 95/22625 A1 | 8/1995 |
| WO | 95/33836 A1 | 12/1995 |
| WO | 96/00787 A1 | 1/1996 |
| WO | 97/00078 A1 | 1/1997 |
| WO | 97/35966 A1 | 10/1997 |
| WO | 98/27230 A1 | 6/1998 |
| WO | 00/42651 A1 | 7/2000 |
| WO | 01/75767 A2 | 10/2001 |
| WO | 2009/008908 A2 | 1/2009 |
| WO | 2010/099501 A2 | 9/2010 |
| WO | 2010/150261 A1 | 12/2010 |
| WO | 2011/005477 A1 | 1/2011 |
| WO | 2012/024104 A2 | 2/2012 |

OTHER PUBLICATIONS

Altschul, S., et al., "Basic local alignment search tool," J. Mol. Biol., 215: 403-410 (1990).
Altschul S.F. et al., "Gapped BLAST and PSI-BLAST: a new generaton of protein database seach programs," Nucleic Acids Res., 25(17):3389-3402 (1997).
Beaucage, S.L., et al., "Deoxynucleoside phosphoamidites—A new class of key intermediates for deoxypolynucleotide synthesis," Tetrahedron Letters, 22(20):1859-62 (1981).
Black, M.E., et al., "Creation of drug-specific herpes simplex virus type 1 thymidine kinase mutants for gene therapy," Proc Natl Acad Sci USA, 93:3525-3529 (1996).
Botstein, D., et al., "Strategies and applications of in vitro mutagenesis," Science, 229(4719):1193-1201, 1985.
Burgey, C.S., et al., "Synthesis of the (3R,6S)-3-Amino-6-(2,3-difluorophenyl)azepan-2-one of Telcagepant (MK-0974), a Calcitonin Gene-Related Peptide Receptor Antagonist for the Treatment of Migraine Headache," Org. Lett., 10(15):3235-3238 (2008).
Caldwell, R.C., et al., "Mutagenic PCR," PCR Methods Appl., 3:S136-S140 (1994).
Carey, F., "Sulfonate esters as substrates in nucleophilic substitution reactions," Organic Chemistry, 2nd ed., pp. 328-331 [1992].
Carter, P., "Site-directed rnutagenesis," Biochem. J., 237:1-7 (1986).
Christians, F.C., et al., "Directed evolution of thymidine kinase for AZT phosphorylation using DNA family shuffling," Nat. Biotechnol., 17:259-264 (1999).
Crameri, A., et al., "DNA shuffling of a family of genes from diverse species accelerates directed evolution", Nature, 391:288-291 (1998).
Crameri, A., et al., "Improved green fluorescent protein by molecular evolution using DNA shuffling," Nat. Biotechnol., 14(3):315-319 (1996).
Crameri, A., et al., "Molecular evolution of an arsenate detoxification pathway by DNA shuffling," Nat. Biotechnol., 15 (5):436-438 (1997).

(Continued)

*Primary Examiner* — Nashaat Nashed
(74) *Attorney, Agent, or Firm* — Codexis, Inc.

(57) ABSTRACT

The present disclosure relates to transaminase polypeptides capable of aminating a dicarbonyl substrate, and polynucleotides, vectors, host cells, and methods of making and using the transaminase polypeptides.

39 Claims, No Drawings

(56) References Cited

OTHER PUBLICATIONS

Dale, S.J., et al., "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl Acad. Sci. USA, 80: 21-25 (1983).

Ehrlich, S.D., "DNA cloning in Bacillus subtilis," Proc Natl Acad Sci. USA, 75:1433 (1978).

Guo, Z., et al., "3'-End-Forming Signals of Yeast mRNA," Mol. Cell. Biol., 15(11):5983-5990 [1995].

Henikoff, S.,et al., "Amino acid substitution matrices from protein blocks," Proc. Natl. Acad. Sci., 89:10915-10919 (1992).

Höhne, M., et al., "Biocatalytic Routes to Optically Active Amines," Chem. Cat. Chem., 1(1):42-51 [2009].

Höhne, M., et al., "Efficient Asymmetric Synthesis of Chiral Amines by Combining Transaminase and Pyruvate Decarboxylase", ChemBioChem, 9:363-365 (2008).

Iwasaki, A., et al., "A novel transaminase, (R)-amine:pyruvate aminotransferase, from Arthrobacter sp. KNK168 (FERM BP-5228):purification, characterization, and gene cloning," Appl. Microbiol. Biotechnol., 93(4): 1563-1573 (2012).

Iwasaki, A., et al., "Microbial synthesis of chiral amines by (R)-specific transamination with Arthrobacter sp. KNK168," Appl. Microbiol. Biotechnol., 69: 499-505 (2006).

Koszelewski, D., et al., "Asymmetric Synthesis of Optically Pure Pharmacologically Relevant Amines Employing ω-Transaminases", Adv. Synth. Catal., 350:2761-2766 (2008).

Koszelewski, D., et al., "Deracemization of mexiletine biocatalyzed by omega-transaminases," Org. Lett., 11 (21):4810-2 (2009).

Koszelewski, D., et al., "Immobilization of omega-transaminases by encapsulation in a sol-gel/celite matrix," Journal of Molecular Catalysis B: Enzymatic, 63: 39-44 (2010).

Kramer, B., et al., "Different base/base mismatches are corrected with different efficiencies by the methyl-directed DNA mismatch-repair system of E. coli," Cell, 38(3):879-887, 1984.

Lathe, R., et al., "Plasmid and bacteriophage vectors for excision of intact inserts," Gene, 57:193-201 (1987).

Lei, S.P, et al., "Characterization of the Erwinia carotovora pelB Gene and Its Product Pectate Lyase," J Bacteriol, 169 (9):4379-4383 (1987).

Ling, M., et al., "Approaches to DNA Mutagenesis:An Overview," Anal. Biochem., 254:157-78 (1997).

Martin, A.R., et al., "Characterization of free and immobilized (S)-aminotransferase for acetophenone production," Applied Microbiology and Biotechnology, 76(4): 843-851 (2007).

Mateo, C., et al., "Epoxy sepabeads: a novel epoxy support for stabilization of industrial enzymes via very intense multipoint covalent attachment," Biotechnology Progress 18(3):629-34 (2002).

Matthes, H.W.D., et al., "Simultaneous rapid chemical synthesis of over one hundred oligonucleotides on a microscale," EMBO J., 3(4):801-05 (1984).

Minshull, J., et al., "Protein evolution by molecular breeding," Curr. Op. Chem. Biol., 3(3):284-290 (1999).

Needleman, S., et al., "A general method applicable to the search for similarities in the amino acid sequence of two proteins," J. Mol. Biol. 48:443-453 (1970).

Paone, D.V., et al., "Potent, Orally Bioavailable Calcitonin Gene-Related Peptide Receptor Antagonists for the Treatment of Migraine: Discovery of N-[(3R,6S)-6-(2,3-Difluorophenyl)-2-oxo-1-(2,2,2-trifluoroethyl)azepan-3-yl]-4-(2-oxo-2,3-dihydro-1H-imidazo[4,5-b]pyridin-1-yl)piperidine-1-carboxamide (MK-0974)," J. Med. Chem., 50:5564-5567 (2007).

Pearson, W.R., "Improved tools for biological sequence comparison," Proc. Nat'l. Acad. Sci. USA, 85:2444-2448 (1988).

Romanos, M.A., et al., "Foreign gene expression in yeast: a review," Yeast 8:423-488 [1992].

Savile, C.K., et al., "Biocatalytic asymmetric synthesis of chiral amines from ketones applied to sitagliptin manufacture," Science 329(5989):305-9 (2010).

Shin, J.S., et al., "Comparison of the omega-transaminases from different microorganisms and application to production of chiral amines," Biosci. Biotechnol. Biochem. 65:1782-1788 (2001).

Simonen, M., et al., "Protein Secretion in Bacillus Species," Microbiological Reviews, 57:109-137 (1993).

Smith, M., "In vitro mutagenesis," Ann. Rev. Genet., 19:423-462 (1985).

Smith, T., et al., "Comparison of Biosequences," Adv. Appl. Math, 2:482-489 (1981).

Stemmer, W., "DNA Shuffling by Random Fragmentation and Reassembly: In vitro Recombination for Molecular Evolution," Proc. Natl. Acad. Sci. USA, 91:10747-10751 (1994).

Stemmer, W.P.C., "Rapid evolution of a protein in vitro by DNA shuffling", Nature, 370:389-391 (1994).

Streitwieser, Jr., A., et al., Introduction to Organic Chemistry, 2nd ed., pp. 169-171 (1981).

Truppo, M.D., et al., "Development of an Improved Immobilized CAL-B for the Enzymatic Resolution of a Key Intermediate to Odanacatib," Organic Process Research & Development, 15:1033-1035 (2011).

Van Ophem, P.W., et al., "Substrate inhibition of D-amino acid transaminase and protection by salts and by reduced nicotinamide adenine dinucleotide: isolation and initial characterization of a pyridoxo intermediate related to inactivation.," Biochemistry 37(9):2879-88 (1998).

Villa-Komaroff, L., et al., "A bacterial clone synthesizing proinsulin," Proc. Natl Acad. Sci. USA, 75:3727-3731 (1978).

Wells, J.A., et al., "Cassette mutagenesis: an efficient method for generation of multiple mutations at defined sites," Gene; 34:315-323 (1985).

Yi, S., et al., "Covalent immobilization of omega-transaminase from Vibrio fluvialis JS17 on chitosan beads," Process Biochemistry 42(5): 895-898 (2007).

Zhang, H., et al., "PolyA_DB: a database for mammalian mRNA polyadenylation," Nucleic Acids Res. 33:D116-D120 (2005).

Zhang, J-H., et al., "Directed evolution of a fucosidase from a galactosidase by DNA shuffling and screening ," Proc. Nat. Acad. Sci., U.S.A., 94:4504-4509 (1997).

Zhao, H., et al., "Molecular evolution by staggered extension process (StEP) in vitro recombination," Nat. Biotechnol., 16:258-261 (1998).

Zhu, D., et al., "Biocatalytic asymmetric amination of carbonyl functional groups—a synthetic biology approach to organic chemistry," Biotechnol J., 4(10):1420-31 (2009).

Geneseq Accession No. AYN58033 dated Mar. 3, 2011.

BIOCATALYSTS AND METHODS FOR THE SYNTHESIS OF SUBSTITUTED LACTAMS

CROSS REFERENCE TO RELATED APPLICATIONS

The present application is a national stage application filed under 35 USC §371 and claims priority to international application PCT/US2012/054300, filed Sep. 7, 2012, and U.S. Provisional Patent Application Ser. No. 61/532,259, filed Sep. 8, 2011. The present application hereby incorporates both of these priority applications by reference, in their entireties and for all purposes.

1. TECHNICAL FIELD

The disclosure relates to biocatalysts and processes using the biocatalysts for the preparation of heterocycles containing a ring nitrogen atom.

2. REFERENCE TO SEQUENCE LISTING, TABLE OR COMPUTER PROGRAM

The official copy of the Sequence Listing is submitted as an ASCII formatted text file via EFS-Web, with a file name of "CX2-097W02 ST25 substitute.txt", a creation date of Jul. 8, 2014, and a size of 1,829,190 bytes. The Sequence Listing filed via EFS-Web is part of the specification and is incorporated in its entirety by reference herein.

3. BACKGROUND

Lactams are cyclic amides and form key structural motifs in many drug compounds. Examples include β-lactam based antibiotics, oral anticoagulant Rivaroxaban, and anticonvulsant Levetiracetam. Although these compounds share a lactam core, important differences emerge in the substitutions on the nitrogen atom and the non-carbonyl carbon atoms of the lactam ring. Substitutions on the lactam carbon ring atoms are described for calcitonin receptor antagonists (Paone et al., 2007, J. Med. Chem., 50:5564-5567; Burgey et al., 2008, Org. Lett., 10(15):3235-3238) and opioid receptor antagonists (U.S. Pat. No. 6,852,713). Various processes have been developed for preparing lactams. The compounds can be formed by acid mediated rearrangement of oximes through a Beckman rearrangement, for example formation of caprolactam from cyclohexanone through a cyclohexanoxime intermediate. An alternative method is the cyclization of amino acids, e.g., lysine cyclized to form ε-caprolactam (US Patent Publication 2007/0149777A1). Other methods for preparing lactams are described in e.g., U.S. Pat. Nos. 4,870,173, 6,054,579, 6,150, 535, 6,770,658, 6,852,713, 7,276,531, and 7,378,410. Particularly challenging for synthesis are stereoisomeric forms of substituted lactams. For example, Burgey et al., supra, describe synthesis of the calcitonin gene related peptide antagonist, telcagepant. This synthesis employs, in part, a ring closure of the compound, benzyl (1R)-1-{[[2-(2,3-difluorophenyl)prop-2-enyl](2,4-dimethoxybenzyl)amino]carbonyl}but-3-enylcarbamate using a Grubbs catalyst to form a protected lactam intermediate compound followed by two steps involving a Pd-mediated reduction to form the trans lactam intermediate tert-butyl (3R,6S)-6-(2,3-difluorophenyl)-2-oxoazepan-3-ylcarbamate in diastereomeric excess.

In view of the foregoing, it is desirable to provide facile methods of synthesizing lactams, in particular substituted lactams, where the synthetic methods display efficient conversion of starting material to the lactam product, employ mild conditions, and where the process can be stereoselective for specific stereoisomers of substituted lactams.

4. SUMMARY

The present disclosure provides engineered polypeptides having transaminase activity, polynucleotides encoding the polypeptides, methods of making the polypeptides, and methods of using the polypeptides for the biocatalytic amination of dicarbonyl substrate compounds, which can then be converted to heterocycles containing a ring nitrogen atom, in particular substituted lactams.

Accordingly, in one aspect, the present disclosure provides engineered transaminases capable of converting substrate compound 2 to the product compound 1 as illustrated in Scheme 1.

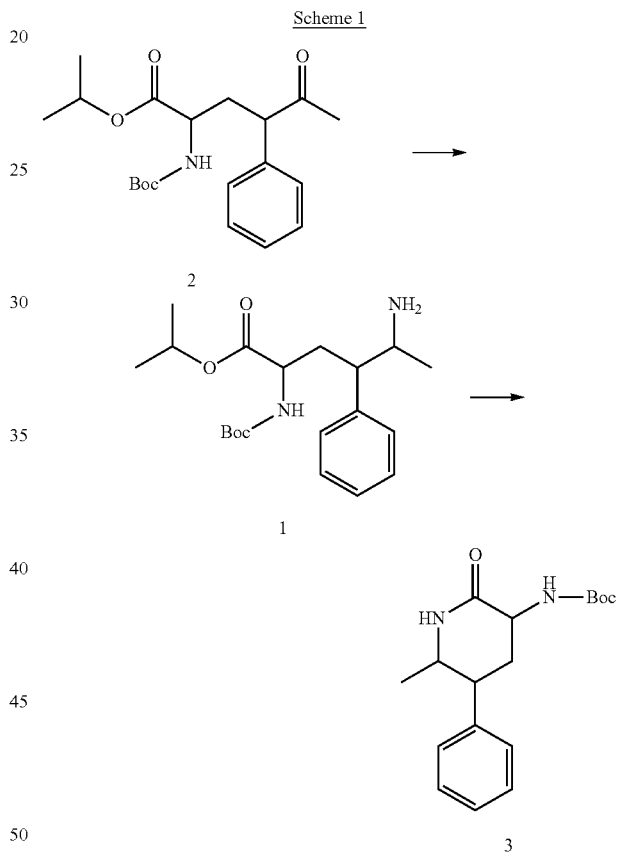

The use of a facile leaving group (e.g., isopropyloxy), allows for direct conversion of the aminated product compound 1 to lactam compound 3 under the reaction conditions of the transaminase. The engineered transaminases of the present disclosure are based on the naturally occurring transaminase of *Arthrobacter* sp. KNK168 (polypeptide of SEQ ID NO: 2), and comprise amino acid sequences having one or more residue differences as compared to the wild-type sequence or the reference sequence corresponding to SEQ ID NO:4. These residue differences occur at residue positions affecting functional properties of the enzyme, including among others, activity (e.g., relative to reference transaminases of SEQ ID NO: 4), stereoselectivity, substrate binding, thermostability, solvent stability, expression, or various combinations thereof.

In some embodiments, the engineered transaminases comprise an amino acid sequence having at least 80% sequence identity to the reference polypeptide of SEQ ID NO: 4 and one or more amino acid residue differences as compared to SEQ ID NO: 4 at residue positions selected from the following: X12; X13; X42; X52; X54; X56; X61; X62; X64; X68; X69; X72; X80; X84; X103; X115; X117; X122; X124; X126; X127; X128; X134; X136; X139; X140; X143; X150; X152; X155; X156; X157; X159; X160; X165; X168; X176; X192; X196; X199; X208; X209; X215; X223; X227; X231; X266; X267; X269; X273; X282; X284; X295; X296; X300; X311; X312; X320; X324; X325; and X327. In some embodiments, the amino acid residue differences as compared to SEQ ID NO: 4 are selected from the following: X12H; X13A; X13F; X42G; X52H; X54A; X54L; X54P; X54R; X56D; X56E; X61G; X61W; X62A; X62L; X62N; X62S; X64C; X68I; X69A; X69G; X69T; X72A; X80Q; X84T; X103G; X115R; X117V; X122F; X122M; X122W; X122Y; X124F; X124K; X124L; X124M; X124N; X124R; X124S, X124W; X126A, X126C, X126I, X126T; X127T; X128A; X134S; X136F, X136K, X136L, X136M, X136Y; X139E; X140K; X143V; X150L, X150S; X152A, X152C, X152F, X152G, X152I, X152L, X152R, X152S, X152W; X155I, X155L, X155T; X156A, X156S, X156T; X157L; X159G; X160L; X165N; X168R; X176C; X192A, X192G, X192H, X192K, X192N, X192Q, X192R, X192S; X196L, X196V; X199L, X199V; X208K; X209F, X209M, X209Q, X209V; X215H; X215L; X223S, X223T, X223V; X227I; X231T; X266N; X267V; X269L; X273H; X282I, X282L, X282V; X284A, X284P, X284S, X284T, X284V; X295S; X296D; X300G; X311T; X312C; X320G; X324Q; X325P, X325V; and X327L. Other amino acid residue differences at other residue positions are further described in the detailed description.

In some embodiments, the engineered transaminases comprise an amino acid sequence having at least 80% sequence identity to the reference polypeptide of SEQ ID NO: 4 and one or more amino acid residue differences as compared to SEQ ID NO: 4 at residue positions selected from the following: X2; X4; X5; X6; X8; X9; X10; X12; X13; X17; X18; X21; X22; X25; X27; X28; X29; X30; X31; X34; X37; X42; X43; X46; X47; X48; X49; X50; X52; X54; X55; X56; X61; X62; X64; X66 X68; X69; X72; X80; X81; X84; X85; X88; X97; X99; X101; X102; X103; X106; X107; X108; X115; X117; X120; X122; X124; X126; X127; X128; X131; X132; X134; X136; X139; X140; X141; X142; X143; X144; X146; X150; X152; X155; X156; X157; X159; X160; X161; X165; X168; X176; X179; X185; X190; X191; X192; X196; X199; X208; X209; X210; X215; X217; X223; X227; X231; X233; X234; X241; X256; X260; X263; X265; X266; X267; X269; X270; X273; X274; X282; X284; X295; X296; X297; X300; X305; X308; X309; X311; X312; X316; X319; X320; X323; X324; X325; X327; and X329. In some embodiments, the amino acid residue differences as compared to SEQ ID NO: 4 are selected from the following: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X10L; X12H; X13A, X13F; X17L; X18I; X21L; X22A, X22H; X25A; X27L, X27H, X27P; X28N; X29N, X29T; X30F, X30G; X31H, X31R; X34V; X37S; X42G; X43S; X46R; X47R; X48A, X48G, X48R, X48S, X48W; X49I, X49P; X50S; X52H; X54A, X54L, X54M, X54P, X54R, X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P; X97T; X99L; X101G, X101L, X101R; X102H, X102R, X102T; X102W; X103G, X103N, X103V; X106L, X106S, X106T, X106V; X107V; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X136F, X136K, X136L, X136M, X136Y; X139E; X140A, X140K; X140M, X140T, X140V; X141A; X142M; X143V; X144D, X144I; X146R; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X192A, X192G, X192H, X192K, X192N, X192Q, X192R, X192S; X196L, X196V; X199L, X199V; X203M; X208K; X209F, X209M, X209Q, X209V; X210G, X210S; X215F, X215H, X215L; X217L; X223A, X223S, X223T, X223V; X227I; X231T; X233D; X234L; X241R; X256R; X260Q; X263V; X265Y, X265W; X266N; X267V; X269L, X269T; X270R, X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X297D; X297G; X300G, X300L; X305Q, X305T; X308A; X309L, X309T, X309W; X311Q, X311T; X312C, X312M; X316L, X316R; X319R; X319T, X319Y; X320G, X320Q; X323C, X323E, X323N, X323R; X324Q; X325M, X325P, X325Q, X325V; X327L, X327R; and X329P. Other amino acid residue differences at other residue positions are further described in the detailed description.

As provided herein, in some embodiments, the disclosed amino acid differences can be used singly or in various combinations to generate the engineered polypeptides having the improved enzyme properties. In some embodiments, the engineered transaminase polypeptide comprises an amino acid sequence having at least 80% sequence identity to reference sequence SEQ ID NO:4 and at least a residue difference as compared to SEQ ID NO:4 at residue position X192. In some embodiments, the amino acid residue at residue position X192 is selected from A, G, H, K, N, Q, R and S.

In some embodiments, the transaminase polypeptide comprises an amino acid sequence having at least 80% sequence identity to SEQ ID NO:4 and one or more residue differences as compared to SEQ ID NO:4 selected from the following: X12H; X13A; X13F; X52H; X54A; X54L; X56D; X56E; X61G; X61W; X62A; X62L; X62N; X62S; X64C; X68I; X72A; X80Q; X84T; X103G; X115R; X117V; X122F; X122W; X122Y; X124K; X124M; X124S; X124W; X126C; X126I; X127T; X128A; X134S; X136K; X136L; X136M; X139E; X140K; X143V; X150L; X152A, X152F; X152R; X152W; X155I; X155L; X159G; X168R; X176C; X192A; X192G; X192H; X192K; X192N; X192Q; X192R; X192S; X196L; X196V; X199L; X199V; X208K; X209F; X209M; X209Q; X209V; X215H; X215L; X223S; X223T; X223V; X227I; X231T; X266N; X269L; X273H; X282I; X282L, X282V; X284A; X284P; X284S; X284T; X284V; X295S; X296D; X300G; X311T; X312C; X320G; X324Q; X325P; X325V; and X327L.

In some embodiments, the transaminase polypeptide comprises an amino acid sequence having at least 80% sequence identity to SEQ ID NO:4 and one or more residue differences as compared to SEQ ID NO:4 selected from the following: X2M; X4F, X4L; X5C, X5F, X5M, X5P, X5Y; X6F, X6R, X6S, X6T; X8H; X9I, X9F, X9L; X10L; X12H; X13A; X13F; X17L; X18I; X21L; X22A, X22H; X25A; X27L, X27H, X27P; X28N; X29N, X29T; X30F, X30G; X31H, X31R; X34V; X37S; X42G; X43S; X46R; X47R; X48R, X48S, X48W; X49I, X49P; X50S; X52H; X54A, X54L, X54M, X54P, X54R; X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P, X97T; X99L; X101G, X101L, X101R; X102H, X102R; X102T; X102W; X103G, X103N, X103V; X106L, X106S, X106T, X106V; X107V; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X136F, X136K, X136L, X136M, X136Y; X139E; X140A, X140K, X140M, X140T, X140V; X141A; X142M; X143V; X144D, X144I; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X192A, X192G, X192H, X192K, X192N, X192Q, X192R, X192S; X196L, X196V; X199L, X199V; X203M; X208K; X209F, X209M, X209Q, X209V; X210G; X215H, X215L; X217L; X223A, X223S, X223T, X223V; X227I; X231T; X233D; X234L; X241R; X256R; X260Q; X263V; X265Y, X265W; X266N; X267V; X269L, X269T; X270R, X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X300G, X300L; X305Q, X305T; X308A; X309L, X309T, X309W; X311Q, X311T; X312C, X312M; X316L, X316R; X319R, X319T, X319Y; X320G, X320Q; X323C, X323E, X323N, X323R; X324Q; X325M, X325P, X325Q, X325V; X327L, X327R; and X329P.

In some embodiments, the transaminase polypeptide comprises an amino acid sequence having a combination of amino acid residue differences as compared to SEQ ID NO:4 selected from: (a) X124W and X327L; (b) X209M and X300G; (c) X122F, X223V and X284A; (d) X192A, X215H and X311T; (e) X62N, X124F, X126A and X136L; (f) X124W, X126A, X136L, X192A and X284A; (g) X124W, X126A, X136L, X152R/X152L/X152I and X192A; (h) X124W, X126A, X136L, X192A, X215F, and X284A; (i) X124W, X126A, X136L, X192A, X215F, X273R, X284A, and X323C; and (j) X124W, X126A, X136L, X191A, X192A, X215F, X273R, X284A, and X323C.

In some embodiments, the transaminase polypeptide comprises an amino acid sequence having a combination of amino acid residue differences as compared to SEQ ID NO:4 that are present in SEQ ID NO: 84 (i.e., X124W, X126A, X136L, X192A and X284A), and further comprising amino acid differences at residue positions compared to SEQ ID NO:4 selected from the following: X2; X4; X5; X6; X8; X9; X10; X17; X18; X21; X22; X25; X27; X28; X29; X30; X31; X34; X37; X43; X46; X47; X48; X49; X50; X55; X66; X81; X85; X88; X97; X99; X101; X102; X106; X107; X108; X120; X131; X132; X141; X142; X144; X146; X161; X179; X185; X190; X191; X210; X217; X233; X234; X241; X256; X260; X263; X265; X270; X274; X297; X305; X308; X309; X316; X319; X323; and X329. In some embodiments, the further amino acid residue differences as compared to SEQ ID NO: 4 are selected from the following: X2M; X4F; X4L; X4Y; X5C; X5F; X5I; X5H; X5K; X5L; X5M; X5N; X5P; X5S; X5T; X5V; X5Y; X6F; X6S; X6T; X8H; X9L; X9I; X6R; X9Q; X9F; X10L; X17L; X18I; X21L; X22A; X22H; X25A; X27L; X27H; X27P; X28N; X29N; X29T; X30F; X30G; X31H; X31R; X34V; X37S; X43S; X46R; X47R; X48A, X48G, X48R, X48S, X48W; X49I, X49P; X50S; X54M;

X55M; X56W; X66A, X66S; X81K; X85L, X85R; X88W; X89L; X97P, X97T; X99L; X101G, X101L, X101R; X102H, X102R, X102T; X102W; X103N, X103V; X106L, X106S, X106T, X106V; X107V; X108T; X120F; X126G; X131F; X132H; X134G, X134L, X134V, X134Y, X134W; X140A; X140M; X140T, X140V; X141A; X142M; X144D, X144I; X146R; X155C; X156F; X161M, X161N; X165L, X165V; X168E; X179K; X185A; X190M, X191A, X191G, X191S; X203M; X210G, X210S; X215F; X217L; X223A; X233D; X234L; X241R; X256R; X260Q; X263V; X265Y; X265W; X269T; X270R, X270T; X273D; X273M; X273R; X273V; X274F; X274L; X274R; X274T; X282T; X295N; X296L, X296R; X296S; X296W; X297D; X297G; X300L; X305Q, X305T; X308A; X309W; X309L, X309T; X311Q; X312M; X316L; X316R; X319R; X319T; X319Y; X320Q; X323C, X323E, X323N, X323R; X325M, X325Q; X327R; and X329P.

Exemplary engineered polypeptides incorporating the amino acid differences, including various combinations thereof, and having improved properties are disclosed in Tables 2A, 2B, 2C, 2D, 2E, 2F, 2G, 2H, and 2I and the Examples. The amino acid sequences are provided in the Sequence Listing and include the sequences having the even-numbered sequence identifiers of SEQ ID NO: 6-854.

In some embodiments, the engineered transaminases display stereoselectivity for compound 1a and compound 1d (i.e., [1a+1d]) over compound 1b and compound 1c (i.e., [1b+1c])

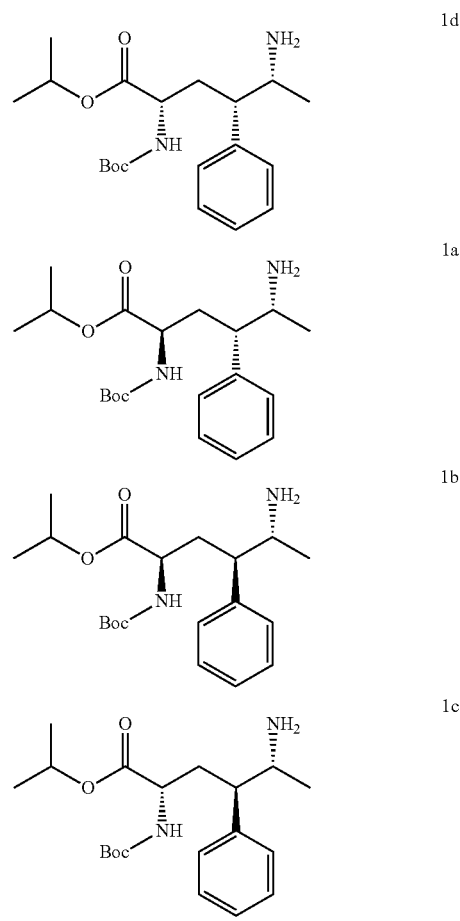

such that, in some embodiments, compounds 1a and compound 1d are produced in diastereomeric ratio greater than 8:1 over compound 1b and compound 1c. Exemplary engineered transaminase polypeptides with stereoselectivity for compound 1a and compound 1d over compound 1b and compound 1c comprise an amino acid sequence selected from SEQ ID NO: 6, 10, 12, 14, 16, 18, 20, 22, 24, 26, 30, 32, 34, 36, 38, 40, 42, 44, 46, 48, 50, 52, 54, 56, 58, 60, 62, 64, 66, 68, 70, 72, 74, 76, 78, 80, 82, 84, 372, 412, 526, 528, 550, 580, 582, 624, 630, 640, 648, 654, 656, 668, 692, 696, 700, 704, 714, 716, 718, 720, 742, 764, 774, 798, 818, 824, and 826.

In some embodiments, the engineered transaminase polypeptides are stereoselective for compound 1d over compound 1a. Exemplary engineered transaminase polypeptides with stereoselectivity for compound 1d over compound 1a comprise an amino acid sequence selected from SEQ ID NO: 6, 8, 10, 12, 14, 22, 24, 28, 30, 32, 44, 48, 50, and 52.

In some embodiments, the transaminase polypeptides are stereoselective for compound 1a over compound 1d. Exemplary engineered transaminase polypeptides with stereoselectivity for compound 1a over compound 1d comprise an amino acid sequence selected from SEQ ID NO: 16, 18, 20, 26, 34, 42, 46, 56, 58, 60, 62, 64, 68, 70, 72, 74, 76, 78, 80, 82, and 84.

In some embodiments, the transaminase polypeptides are immobilized on a solid support. In some embodiments, the solid support is a bead or resin comprising polymethacrylate with epoxide functional groups, polymethacrylate with amino epoxide functional groups, styrene/DVB copolymer or polymethacrylate with octadecyl functional groups.

In another aspect, the present disclosure provides polynucleotides encoding the engineered transaminases capable of converting compound 2 to compound 1, as well as expression vectors comprising the polynucleotides, and host cells capable of expressing the polynucleotides encoding the polypeptides. In some embodiments, the present disclosure also provides methods of manufacturing the engineered transaminase polypeptides, wherein the methods comprise culturing a host cell capable of expressing a polynucleotide encoding the engineered transaminase polypeptide under conditions suitable for expression of the polypeptide. Exemplary polynucleotide sequences are provided in the Sequence Listing incorporated by reference herein and include the sequences having the odd-numbered sequence identifiers of SEQ ID NO: 5-853.

In another aspect, the engineered transaminases polypeptides can be used in a process for the conversion of substrate compounds of structural formula II to product compounds of structural formula I, as shown in Scheme 3, Scheme 3

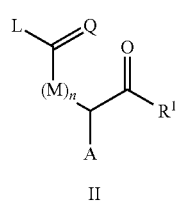

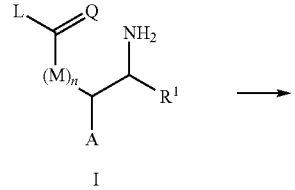

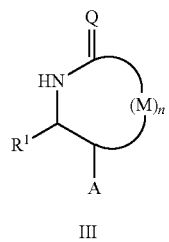

wherein

L is a leaving group;

A is an optionally substituted cycloalkyl, heterocycloalkyl, aryl, heteroaryl, fused aryl, or fused heteroaryl;

$R^1$ is H or an optionally substituted $(C_1-C_6)$ alkyl;

Q is O or S;

M is —$CR^aR^b$—, wherein each M is independent of the other and $R^a$ and $R^b$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and n is an integer from 0 to 4.

As shown in Scheme 3, cyclization of the product compound of structural formula I allows synthesis of nitrogen containing heterocycles of structural formula III. Appropriate selection of the leaving group allows direct formation of compounds of structural formula III under the reaction conditions of the transaminase reaction, thereby providing a facile method for synthesis of the heterocycle. Various substrate compounds within the scope of structural formula II can be used to prepare the corresponding product compounds of structural formula I, which then serves as intermediates for preparing the heterocycles within the scope of structural formula III.

Accordingly, in some embodiments, a process for preparing the compound of structural formula I comprises contacting the compound of structural formula II with any of the engineered transaminases of the present disclosure in presence of an amine donor under suitable reaction conditions. Logically, a process for preparing the corresponding compound of structural formula III comprises (a) preparing the compound of formula I, and (b) cyclizing the compound of structural formula II.

In some embodiments of the process, the compound of structural formula II is the compound of formula 2p,

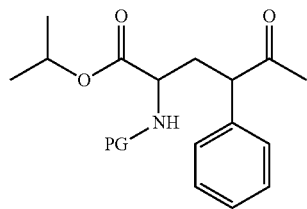
2p where PG is a protecting group, thereby producing the compound of formula 1p:

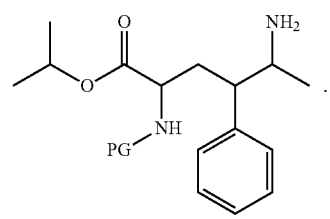
1p

In some embodiments, the compound of formula 3p

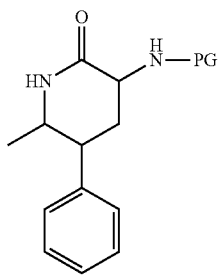
3p is readily formed by: (a) preparing the compound of formula 1p, and (b) cyclizing the compound of formula 1p.

In some embodiments, the process can be used to prepare various stereoisomers of compound 1 in stereomeric excess by using engineered transaminases with the appropriate stereoselectivity. Accordingly, in some embodiments, the process can be used to prepare compound 1d1 and compound 1a1

1d1

1a1

1b1

1c1 in diastereomeric excess of compound 1b1 and compound 1c1 by contacting compound 2p with an engineered transaminase stereoselective for compound 1d1 and compound 1a1 over compound 1b1 and compound 1c1 in presence of an amino donor under suitable reaction conditions.

In some embodiments of the process, compound 1d1 can be prepared in diastereomeric excess over compound 1a1 by contacting compound 2p with an engineered transaminase stereoselective for compound 1d1 over compound 1a1 in presence of an amino donor under suitable reaction conditions.

In some embodiments of the process, compound 1a1 can be prepared in diastereomeric excess of compound 1d1 by contacting compound 2p with an engineered transaminase stereoselective for compound 1a1 over compound 1d1 in presence of an amino donor under suitable reaction conditions.

In some embodiments, by cyclizing the product compounds of the stereoselective transaminase reactions, various stereoisomers of compound 3p can be prepared in stereomeric excess. Accordingly, in some embodiments, compound 3d1 and compound 3a1 can be prepared in diastereomeric excess over compound 3b1 and compound 3c1

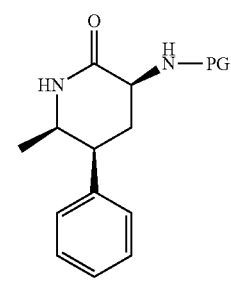
3d1

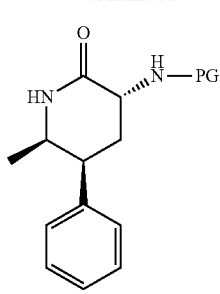

3a1

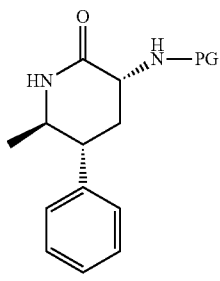

3b1

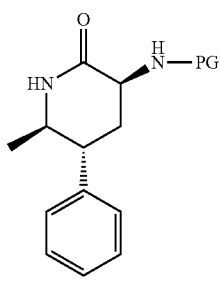

3c1 by: (a) preparing compound 1d1 and compound 1a1 in diastereomeric excess of compound 1b1 and compound 1c1, and (b) cyclizing the products of step (a).

In some embodiments, compound 3d1 can be prepared in diastereomeric excess of compound 3a1 by: (a) preparing compound 1d1 in diastereomeric excess of compound 1a1, and (b) cyclizing the products of step (a).

In some embodiments, compound 3a1 can be prepared in diastereomeric excess of compound 3d1 by: (a) preparing compound 1a1 in diastereomeric excess of compound 1d1, and (b) cyclizing the products of step (a).

Parameters for carrying out transamination and cyclization processes, including among others substrate compound loading, enzyme loading, cofactor loading, amino donor, solvent conditions (e.g., buffer, DMSO, etc.), pH and temperature are further described in the detailed description below.

5. DETAILED DESCRIPTION

As used in this specification and the appended claims, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," "including," "have," and "having" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

It is to be understood that both the foregoing general description, including the drawings, and the following detailed description are exemplary and explanatory only and are not restrictive of this disclosure.

The section headings used herein are for organizational purposes only and not to be construed as limiting the subject matter described.

5.1 Abbreviations

The abbreviations used for the genetically encoded amino acids are conventional and are as follows:

| Amino Acid | Three-Letter Abbreviation | One-Letter Abbreviation |
|---|---|---|
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | HIS | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

5.2 Definitions

In reference to the present disclosure, the technical and scientific terms used in the descriptions herein will have the meanings commonly understood by one of ordinary skill in the art, unless specifically defined otherwise. Accordingly, the following terms are intended to have the following meanings:

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Transaminase" or "aminotransferase" are used interchangeably herein to refer to a polypeptide having an enzymatic capability of transferring an amino group (—NH$_2$), a pair of electrons, and a proton from a primary amine to a carbonyl group (C=O) of an acceptor molecule. Transaminases as used herein include naturally occurring (wild type) transaminase as well as non-naturally occurring engineered polypeptides generated by human manipulation.

"Amino acceptor" and "amine acceptor," "keto substrate," are used interchangeably herein to refer to a carbonyl compound which accepts an amino group from a donor amine. Amino acceptors are molecules of general formula shown below,

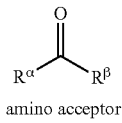

amino acceptor in which each of $R^\alpha$ and $R^\beta$, when taken independently, is a hydrogen, alkyl, an alkylaryl group, or aryl group which is unsubstituted or substituted with one or more enzymatically acceptable groups, with the proviso that when either of $R^\alpha$ or $R^\beta$ is H, the other is an alkyl, an alkylaryl group, or aryl group. $R^\alpha$ may be the same or different from $R^\beta$ in structure or chirality. In some embodiments, $R^\alpha$ and $R^\beta$, taken together, may form a ring that is unsubstituted, substituted, or fused to other rings. Amino acceptors include aldehydes, keto carboxylic acids and alkanones (ketones). Typical keto carboxylic acids are α-keto carboxylic acids such as glyoxalic acid, pyruvic acid, oxaloacetic acid, and the like, as well as salts of these acids. Amino acceptors also include substances which are converted to an amino acceptor by other enzymes or whole cell processes, such as fumaric acid (which can be converted to oxaloacetic acid), glucose (which can be converted to pyruvate), lactate, maleic acid, and others. Amino acceptors that can be used include, by way of example and not limitation, (R)-2-(3,4-dimethoxyphenethoxy)cyclohexanone, 3,3-dihydronaphthalen-1(2H)-one, 1-phenylbutan-2-one, 3,3-dimethylbutan-2-one, octan-2-one, ethyl 3-oxobutanoate, 4-phenylbutan-2-one, 1-(4-bromophenyl)ethanone, 2-methyl-cyclohexanone, 7-methoxy-2-tetralone, 1-hydroxybutan-2-one, pyruvic acid, acetophenone, (R)-2-(3,4-dimethoxyphenethoxy)cyclohexanone, 2-methoxy-5-fluoroacetophenone, levulinic acid, 1-phenylpropan-1-one, 1-(4-bromophenyl)propan-1-one, 1-(4-nitrophenyl)propan-1-one, 1-phenylpropan-2-one, 2-oxo-3-methylbutanoic acid, 1-(3-trifluoromethylphenyl)propan-1-one, hydroxypropanone, methoxyoxypropanone, 1-phenylbutan-1-one, 1-(2,5-dimethoxy-4-methylphenyl)butan-2-one, 1-(4-hydroxyphenyl)butan-3-one, 2-acetylnaphthalene, phenylpyruvic acid, 2-ketoglutaric acid, and 2-ketosuccinic acid, including both (R) and (S) single isomers where possible.

"Amino donor" or "amine donor" refers to an amino compound which donates an amino group to the amino acceptor, thereby becoming a carbonyl species. Amino donors are molecules of general formula shown below,

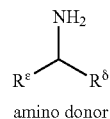

amino donor in which each of $R^\epsilon$ and $R^\delta$, when taken independently, is an alkyl, an alkylaryl group, or aryl group which is unsubstituted or substituted with one or more enzymatically non-inhibiting groups. $R^\epsilon$ can be the same or different from $R^\delta$ in structure or chirality. In some embodiments, $R^\epsilon$ and $R^\delta$, taken together, may form a ring that is unsubstituted, substituted, or fused to other rings. Typical amino donors that can be used with the embodiments of the present disclosure include chiral and achiral amino acids, and chiral and achiral amines. Exemplary amino donors that can be used with the embodiments herein include, by way of example and not limitation, isopropylamine (also referred to as 2-aminopropane, and referred to elsewhere herein as "IPM"), α-phenethylamine (also termed 1-phenylethanamine), and its enantiomers (S)-1-phenylethanamine and (R)-1-phenylethanamine, 2-amino-4-phenylbutane, glycine, L-glutamic acid, L-glutamate, monosodium glutamate, L-alanine, D-alanine, D,L-alanine, L-aspartic acid, L-lysine, D,L-ornithine, β-alanine, taurine, n-octylamine, cyclohexylamine, 1,4-butanediamine (also referred to as putrescine), 1,6-hexanediamine, 6-aminohexanoic acid, 4-aminobutyric acid, tyramine, and benzyl amine, 2-aminobutane, 2-amino-1-butanol, 1-amino-1-phenylethane, 1-amino-1-(2-methoxy-5-fluorophenyl)ethane, 1-amino-1-phenylpropane, 1-amino-1-(4-hydroxyphenyl)propane, 1-amino-1-(4-bromophenyl)propane, 1-amino-1-(4-nitrophenyl)propane, 1-phenyl-2-aminopropane, 1-(3-trifluoromethylphenyl)-2-aminopropane, 2-aminopropanol, 1-amino-1-phenylbutane, 1-phenyl-2-aminobutane, 1-(2,5-dimethoxy-4-methylphenyl)-2-aminobutane, 1-phenyl-3-aminobutane, 1-(4-hydroxyphenyl)-3-aminobutane, 1-amino-2-methylcyclopentane, 1-amino-3-methylcyclopentane, 1-amino-2-methylcyclohexane, 1-amino-1-(2-naphthyl)ethane, 3-methylcyclopentylamine, 2-methylcyclopentylamine, 2-ethylcyclopentylamine, 2-methylcyclohexylamine, 3-methylcyclohexylamine, 1-aminotetralin, 2-aminotetralin, 2-amino-5-methoxytetralin, and 1-aminoindan, including both (R) and (S) single isomers where possible and including all possible salts of the amines.

"Chiral amine" refers to amines of general formula $R^\alpha$—CH(NH$_2$)—$R^\beta$ and is employed herein in its broadest sense, including a wide variety of aliphatic and alicyclic compounds of different, and mixed, functional types, characterized by the presence of a primary amino group bound to a secondary carbon atom which, in addition to a hydrogen atom, carries either (i) a divalent group forming a chiral cyclic structure, or (ii) two substituents (other than hydrogen) differing from each other in structure or chirality. Divalent groups forming a chiral cyclic structure include, for example, 2-methylbutane-1,4-diyl, pentane-1,4-diyl, hexane-1,4-diyl, hexane-1,5-diyl, 2-methylpentane-1,5-diyl. The two different substituents on the secondary carbon atom ($R^\alpha$ and $R^\beta$ above) also can vary widely and include alkyl, arylalkyl, aryl, halo, hydroxy, lower alkyl, lower alkyloxy, lower alkylthio, cycloalkyl, carboxy, carbalkyloxy, carbamoyl, mono- and di-(lower alkyl) substituted carbamoyl, trifluoromethyl, phenyl, nitro, amino, mono- and di-(lower alkyl) substituted amino, alkylsulfonyl, arylsulfonyl, alkylcarboxamido, arylcarboxamido, etc., as well as alkyl, arylalkyl, or aryl substituted by the foregoing.

"Pyridoxal-phosphate," "PLP," "pyridoxal-5'-phosphate," "PYP," and "P5P" are used interchangeably herein to refer to the compound that acts as a cofactor in transaminase reactions. In some embodiments, pyridoxal phosphate is defined by the structure 1-(4'-formyl-3'-hydroxy-2'-methyl-5'-pyridyl)methoxyphosphonic acid, CAS number [54-47-7]. Pyridoxal-5'-phosphate can be produced in vivo by phosphorylation and oxidation of pyridoxol (also known as Vitamin $B_6$). In transamination reactions using transaminase enzymes, the amine group of the amino donor is transferred to the cofactor to produce a keto byproduct, while pyridoxal-5'-phosphate is converted to pyridoxamine phosphate. Pyridoxal-5'-phosphate is regenerated by reaction with a different keto compound (the amino acceptor). The transfer of the amine group from pyridoxamine phosphate to the amino acceptor produces an amine and regenerates the cofactor. In some embodiments, the pyridoxal-5'-phosphate can be replaced by other members of the vitamin $B_6$ family, including pyridoxine (PN), pyridoxal (PL), pyridoxamine (PM), and their phosphorylated counterparts; pyridoxine phosphate (PNP), and pyridoxamine phosphate (PMP).

"Cofactor," as used herein, refers to a non-protein compound that operates in combination with an enzyme in catalyzing a reaction. As used herein, "cofactor" is intended to encompass the vitamin $B_6$ family compounds PLP, PN, PL, PM, PNP, and PMP, which are sometimes also referred to as coenzymes.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Examples of algorithms that are suitable for determining percent sequence identity and sequence similarity are the BLAST and BLAST 2.0 algorithms, which are described in Altschul et al., 1990, J. Mol. Biol. 215: 403-410 and Altschul et al., 1977, Nucleic Acids Res. 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:2 having at the residue corresponding to X9 a histidine" refers to a reference sequence in which the corresponding residue at X9 in SEQ ID NO:2, which is a tyrosine, has been changed to histidine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered transaminase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X12 as compared to SEQ ID NO: 2" refers to a difference of the amino acid residue at the polypeptide position corresponding to position 12 of SEQ ID NO:2. Thus, if the reference polypeptide of SEQ ID NO: 2 has a tyrosine at position 12, then a "residue difference at position X12 as compared to SEQ ID NO:2" an amino acid substitution of any residue other than tyrosine at the position of the polypeptide corresponding to position 12 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in Tables 2A, 2B, 2C, and 2D), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/X192G). The present disclosure includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acids having aromatic side chains is substituted with another amino acid having an aromatic side chain, e.g., phenylalanine, tyrosine, tryptophan, and histidine; an amino acid with a basic side chain is substituted with another amino acid with a basis side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided in Table 1 below:

TABLE 1

| Residue | Possible Conservative Substitutions |
| --- | --- |
| A, L, V, I | Other aliphatic (A, L, V, I) |
| | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered transaminase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered transaminase enzymes comprise insertions of one or more amino acids to the naturally occurring transaminase polypeptide as well as insertions of one or more amino acids to other improved transaminase polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of a full-length transaminase polypeptide.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved transaminase enzymes may be present within a cell, present in the cellular medium, or prepared in various forms, such as lysates or isolated preparations. As such, in some embodiments, the improved transaminase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure transaminase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated improved transaminases polypeptide is a substantially pure polypeptide composition.

"Stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Where a mixture contains more than two diastereomers it is common to report the ratio of diastereomers or "diastereomeric ratio" rather than diastereomeric excess. Enantiomeric excess and diastereomeric excess are types of stereomeric excess. "Highly stereoselective" refers to a transaminase polypeptide that is capable of converting the substrate to the corresponding chiral amine product with at least about 85% stereomeric excess.

"Improved enzyme property" refers to a transaminase polypeptide that exhibits an improvement in any enzyme property as compared to a reference transaminase, such as the wild-type transaminase enzyme or another improved engineered transaminase. Enzyme properties for which improvement is desirable include, but are not limited to, enzymatic activity (which can be expressed in terms of percent conversion of the substrate), thermo stability, solvent stability, pH activity profile, cofactor requirements, refractoriness to inhibitors (e.g., substrate or product inhibition), stereospecificity, and stereoselectivity (including enantioselectivity).

"Increased enzymatic activity" refers to an improved property of the engineered transaminase polypeptides, which can be represented by an increase in specific activity (e.g., product produced/time/weight protein) or an increase in percent conversion of the substrate to the product (e.g., percent conversion of starting amount of substrate to product in a specified time period using a specified amount of transaminase) as compared to the reference transaminase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.1 fold the enzymatic activity of the corresponding wild-type transaminase enzyme, to as much as 2 fold, 5 fold, 10 fold, 20 fold, 25 fold, 50 fold, 75 fold, 100 fold, or more enzymatic activity than the naturally occurring transaminase or another engineered transaminase from which the transaminase polypeptides were derived. In specific embodiments, the engineered transaminase enzyme exhibits improved enzymatic activity in the range of 1.5 to 50 fold, 1.5 to 100 fold or greater than that of the parent transaminase enzyme. Transaminase activity can be measured by any one of standard assays, such as by monitoring changes in spectrophotometric properties of reactants or products. In some embodiments, the amount of products produced can be measured by High-Performance Liquid Chromatography (HPLC) separation combined with UV absorbance or fluorescent detection following o-phthaldialdehyde (OPA) derivatization. Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a transaminase polypeptide can be expressed as "percent conversion" of the substrate to the product.

"Thermostable" refers to a transaminase polypeptide that maintains similar activity (more than 60% to 80% for example) after exposure to elevated temperatures (e.g., 40-80° C.) for a period of time (e.g., 0.5-24 hrs) compared to the wild-type enzyme.

"Solvent stable" refers to a transaminase polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Codon optimized" refers to changes in the codons of the polynucleotide encoding a protein to those preferentially used in a particular organism such that the encoded protein is more efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the transaminases enzymes may be codon optimized for optimal production from the host organism selected for expression.

"Control sequence" refers herein to include all components, which are necessary or advantageous for the expression of a polynucleotide and/or polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Alkyl" refers to groups of from 1 to 18 carbon atoms, either straight chained or branched, particularly from 1 to 8 carbon atoms, and more particularly 1 to 6 carbon atoms. An alkyl with a specified number of carbon atoms is denoted in parenthesis, e.g., (C1-C4)alkyl refers to an alkyl of 1 to 4 carbon atoms.

"Alkenyl" refers to groups of from 2 to 12 carbon atoms, either straight or branched containing at least one double bond but optionally containing more than one double bond.

"Alkynyl" refers to groups of from 2 to 12 carbon atoms, either straight or branched containing at least one triple bond but optionally containing more than one triple bond, and optionally containing one or more double bonded moieties.

"Aryl" refers to an unsaturated aromatic carbocyclic group of from 5 to 14 carbon atoms having a single ring (e.g., phenyl) or multiple condensed rings (e.g., naphthyl or anthryl). For multiple condensed rings, at least one of the rings is aromatic. Representative aryls include phenyl, pyridyl, naphthyl and the like.

"Arylalkyl" refers to an alkyl substituted with an aryl moiety. Representative arylalkyl groups include benzyl, phenethyl and the like.

"Arylalkenyl" refers to an alkenyl as defined herein substituted with an aryl group.

"Arylalkynyl" refers to an alkynyl as defined herein substituted with an aryl group.

"Heteroaryl" refers to an aromatic heterocyclic group of 5 to 14 ring atoms containing 1 to 4 ring heteroatoms selected from oxygen, nitrogen and sulfur within the ring. Heteroaryl groups can have a single ring (e.g., pyridyl or furyl) or multiple condensed rings (e.g., indolizinyl or benzothienyl). For multiple condensed rings, at least one of the rings is aromatic.

"Heteroarylalkyl" refers to an alkyl substituted with a heteroaryl moiety as defined herein.

"Heteroarylalkenyl" refers to an alkenyl substituted with a heteraryl group as defined herein.

"Heteroarylalkynyl" refers to an alkynyl substituted with a heteroaryl moiety as defined herein.

"Cycloalkyl" refers to cyclic alkyl groups of from 3 to 12 carbon atoms having a single cyclic ring or multiple condensed rings. Representative cycloalkyl groups include, by way of example, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Heterocycle" and interchangeably "heterocycloalkyl" refer to a saturated or unsaturated group having a single ring or multiple condensed rings, from 3 to 14 ring atoms having from 1 to 4 hetero atoms selected from nitrogen, sulfur or oxygen within the ring. Heterocyclic groups can have a single ring (e.g., piperidinyl or tetrahydrofuryl) or multiple condensed rings (e.g., indolinyl, dihydrobenzofuran or quinuclidinyl). Representative heterocycles and heteroaryls include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Cycloalkylalkyl" refers to an alkyl substituted with a cycloalkyl moiety as defined herein.

"Cycloalkylalkenyl" refers to an alkenyl substituted with a cycloalkyl moiety as defined herein.

"Cycloalkylalkynyl" refers to an alkynyl substituted with a cycloalkyl moiety as defined herein.

"Heterocycloalkylalkyl" refers to an alkyl substituted with a heterocycloalkyl moiety as defined herein.

"Heterocycoalkenyl" refers to an alkenyl substituted with a heterocycloalkyl moiety as defined herein.

"Heterocycloalkylalkynyl" refers to an alkynyl substituted with a heterocycloalkyl moiety as defined herein.

"Alkoxy" or "Alkyloxy" refers to the group alkyl-O— wherein the alkyl group is as defined above, including optionally substituted alkyl groups as also defined above.

"Amino" refers to the group —NH$_2$. Substituted amino refers to the group —NHR', NR'R', and NR'R'R', where each R' is independently of the others selected from substituted or unsubstituted alkyl, cycloalkyl, heterocycloalkyl, cycloalkylalkyl, heterocycloalkylalkyl, alkyloxy, aryl, heteroaryl, arylalkyl, heteroarylalkyl, acyl, alkyloxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

"Carboxy" refers to —COOH.

"Carbonyl" refers to —C(O)—, which may have a variety of substituents to form different carbonyl groups including acids, acid halides, aldehydes, amides, esters, and ketones.

"Hydroxy" refers to —OH.

"Cyano" refers to —CN.

"Halogen" or "halo" refers to fluoro, chloro, bromo and iodo.

"Sulfonyl" refers to —SO$_2$—. Substituted sulfonyl refers to —SO$_2$R', where R' is a suitable substituent as described below.

"Fused" or "fused rings" such as in fused aryl or fused heteroaryl refers to two or more rings joined such that they have at least two ring atoms in common Fused aryl refers to fused rings in which at least one of the rings is an aryl. Fused heteroaryl refers to fused rings in which at least one of the rings is a heteroaryl.

"Lactam" refers to cyclic amides of the general structure:

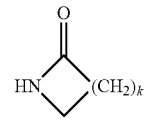

where k is 1 to 7, more particularly 1 to 5. The hydrogen on the nitrogen atom and the hydrogens of the non-carbonyl carbon ring atoms can be replaced with a compatible substituent. Representative lactams include, among others, 2-azetidinon-1-yl, 2-pyrrolidon-1-yl and 2-piperidinon-1-yl.

"Substituted" unless otherwise specified, refers to replacement of positions occupied by hydrogen in the foregoing groups with substituents exemplified by, but not limited to, hydroxy, oxo, nitro, methoxy, ethoxy, alkyloxy, substituted alkyloxy, trifluoromethoxy, haloalkyloxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkyloxyalkyl, thio, alkylthio, acyl, carboxy, alkyloxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

"Optional" or "optionally" means that the subsequently described event or circumstance may or may not occur, and that the description includes instances where said event or circumstance occurs and instances in which it does not. One of ordinary skill in the art would understand that with respect to any molecule described as containing one or more optional substituents, only sterically practical and/or synthetically feasible compounds are meant to be included. "Optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

"Protecting group" refers to a group of atoms that mask, reduce or prevent the reactivity of the functional group when attached to a reactive functional group in a molecule. Typically, a protecting group may be selectively removed as desired during the course of a synthesis. Examples of protecting groups can be found in Wuts and Greene, "Greene's Protective Groups in Organic Synthesis," 4th Ed., Wiley Interscience (2006), and Harrison et al., Compendium of Synthetic Organic Methods, Vols. 1-8, 1971-1996, John Wiley & Sons, NY. Functional groups that can have a protecting group include, but are not limited to, hydroxy, amino, and carboxy groups. Representative amino protecting groups include, but are not limited to, formyl, acetyl, trifluoroacetyl, benzyl, benzyloxycarbonyl ("CBZ"), tert-butoxycarbonyl ("Boc"), trimethylsilyl ("TMS"), 2-trimethylsilyl-ethanesulfonyl ("SES"), trityl and substituted trityl groups, allyloxycarbonyl, 9-fluorenylmethyloxycarbonyl ("FMOC"), nitro-veratryloxycarbonyl ("NVOC") and the like. Representative hydroxyl protecting groups include, but are not limited to, those where the hydroxyl group is either acylated (e.g., methyl and ethyl esters, acetate or propionate groups or glycol esters) or alkylated such as benzyl and trityl ethers, as well as alkyl ethers, tetrahydropyranyl ethers, trialkylsilyl ethers (e.g., TMS or TIPPS groups) and allyl ethers. Other protecting groups can be found in the references noted herein.

"Leaving group" generally refers to any atom or moiety that is capable of being displaced by another atom or moiety in a chemical reaction. More specifically, a leaving group refers to an atom or moiety that is readily displaced and substituted by a nucleophile (e.g., an amine, a thiol, an alcohol, or cyanide). Such leaving groups are well known and include carboxylates, N-hydroxysuccinimide ("NHS"), N-hydroxybenzotriazole, a halogen (fluorine, chlorine, bromine, or iodine), and alkyloxy groups. Non-limiting characteristics and examples of leaving groups can be found, for example in Organic Chemistry, 2d ed., Francis Carey (1992), pages 328-331; Introduction to Organic Chemistry, 2d ed., Andrew Streitwieser and Clayton Heathcock (1981), pages 169-171; and Organic Chemistry, 5th Ed., John McMurry, Brooks/Cole Publishing (2000), pages 398 and 408; all of which are incorporated herein by reference.

"Suitable reaction conditions" refers to those conditions in the biocatalytic reaction solution (e.g., ranges of enzyme loading, substrate loading, cofactor loading, temperature, pH, buffers, co-solvents, etc.) under which a transaminase polypeptide of the present disclosure is capable of converting compound 2 to compound 1, including specific diastereomers of compound 1. Exemplary "suitable reaction conditions" are provided in the present disclosure and illustrated by the Examples.

"Loading", such as in "compound loading" or "enzyme loading" refers to the concentration or amount of a component in a reaction mixture at the start of the reaction.

"Substrate" in the context of a biocatalyst mediated process refers to the compound or molecule acted on by the biocatalyst. For example, an exemplary substrate for the transaminase biocatalyst in the processes disclosed herein is compound 2.

"Product" in the context of a biocatalyst mediated process refers to the compound or molecule resulting from the action of the biocatalyst. For example, an exemplary product for the transaminase biocatalyst in the processes disclosed herein is compound 1.

5.3 Engineered Transaminase Polypeptides for the Synthesis of Lactams

Transaminases, also known as aminotransferases, catalyze the transfer of an amino group, a pair of electrons, and a proton from a primary amine of an amino donor substrate to the carbonyl group (e.g., a keto group) of an amino acceptor molecule. Transaminases have been identified from various organisms, such as *Alcaligenes denitrificans, Arthrobacter, Bordetella bronchiseptica, Bordetella parapertussis, Brucella melitensis, Burkholderia malle, Burkholderia pseudomallei, Chromobacterium violaceum, Oceanicola granulosus* HTCC2516, *Oceanobacter* sp. RED65, *Oceanospirillum* sp. MED92, *Pseudomonas putida, Ralstonia solanacearum, Rhizobium meliloti, Rhizobium* sp. (strain NGR234), *Bacillus thuringensis, Vibrio fluvialis*, and *Klebsiella pneumoniae* (see e.g., Shin et al., 2001, Biosci. Biotechnol. Biochem. 65:1782-1788).

The stereoselectivity of transaminases in the conversion of a ketone to the corresponding amine make these enzymes useful in the asymmetric synthesis of optically pure amines from the corresponding keto compounds (see, e.g., Höhne et al., Biocatalytic Routes to Optically Active Amines," Chem. Cat. Chem. 1(1):42-51; Zua and Hua, 2009, Biotechnol J. 4(10):1420-31). Transaminases can also be applied to the chiral resolution of racemic amines by exploiting the ability of the transaminases to carry out the reverse reaction in a stereospecific manner, i.e., preferential conversion of one enantiomer to the corresponding ketone, thereby resulting in a mixture enriched in the other enantiomer (see, e.g., Koselewski et al., 2009, Org. Lett. 11(21):4810-2).

Both (R)-selective and (S)-selective transaminases are known. The wild-type transaminase from *Arthrobacter* sp. KNK168 is an (R)-selective pyridoxal 5'-phosphate (PLP)-dependent enzyme that produces (R)-amines from some substrates (see e.g., Iwasaki et al., Appl. Microbiol. Biotechnol., 2006, 69: 499-505; and U.S. Pat. No. 7,169,592). US patent publication no. 2010/0285541A1 and published International application WO2010/099501, disclose engineered transaminase polypeptides derived from the naturally occurring transaminase of *Arthrobacter* sp. KNK168 that have increased stability to temperature and/or organic solvent, and which have been adapted to have enzymatic activity towards structurally different amino acceptor molecules (see also e.g., Savile, et al., 2010, "Biocatalytic asymmetric synthesis of chiral amines from ketones applied to sitagliptin manufacture," Science 329(5989):305-9).

Described in the present disclosure are engineered polypeptides having transaminase activity useful for selective transamination of dicarbonyl substrates, the amine products of which can be used for preparation of lactams, particularly substituted lactams. Further disclosed are polynucleotides encoding the engineered polypeptides, and methods for using the engineered polypeptides. Accordingly, in one aspect, the present disclosure relates to engineered transaminase polypeptides which are capable of converting substrate compound 2 to product compound 1 as shown in Scheme 1 above.

Cyclization of product compound 1 results in formation of the corresponding lactam, compound 3. As further explained herein, where the choice of the leaving group (e.g., an alkyloxy group) allows facile cyclization in the reaction conditions of the transaminase reaction, the transaminase polypeptides can be used in a direct reaction to produce the cyclized products, in particular compound 3, including specific stereoisomers, in one pot in high yield. As will be apparent to the skilled artisan, compound 2 has three chiral centers, and can exist in several different stereoisomeric forms. Because transaminases can carry out the reverse reaction to convert an amine of compound 1 to the corresponding ketone of compound 2, the reaction mixture can contain at least four different diastereomeric forms of compound 2 (compounds 2a to 2d), as illustrated below in Scheme 2.

Scheme 2
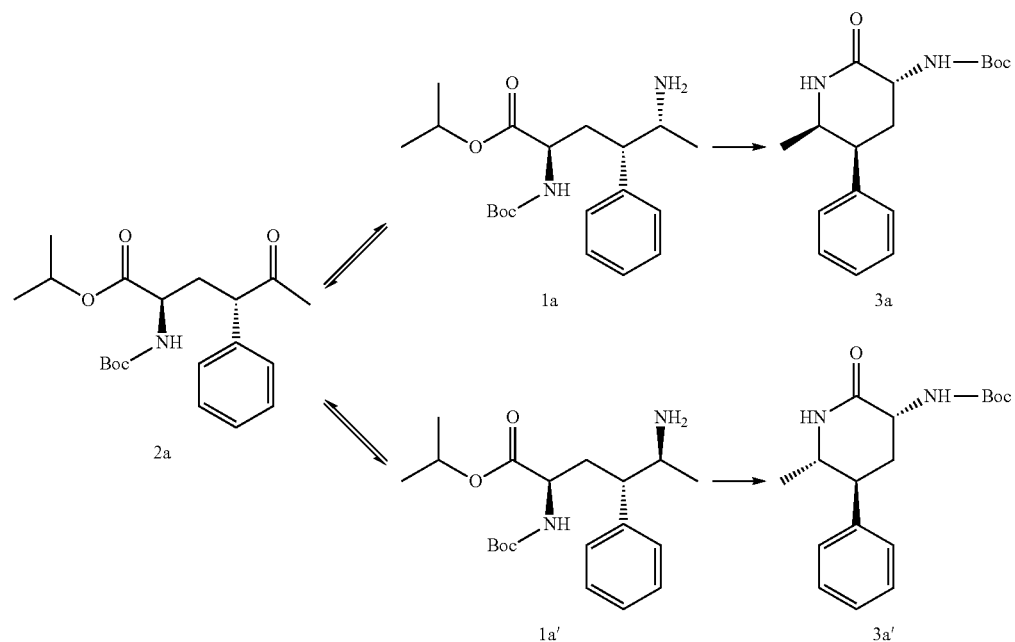
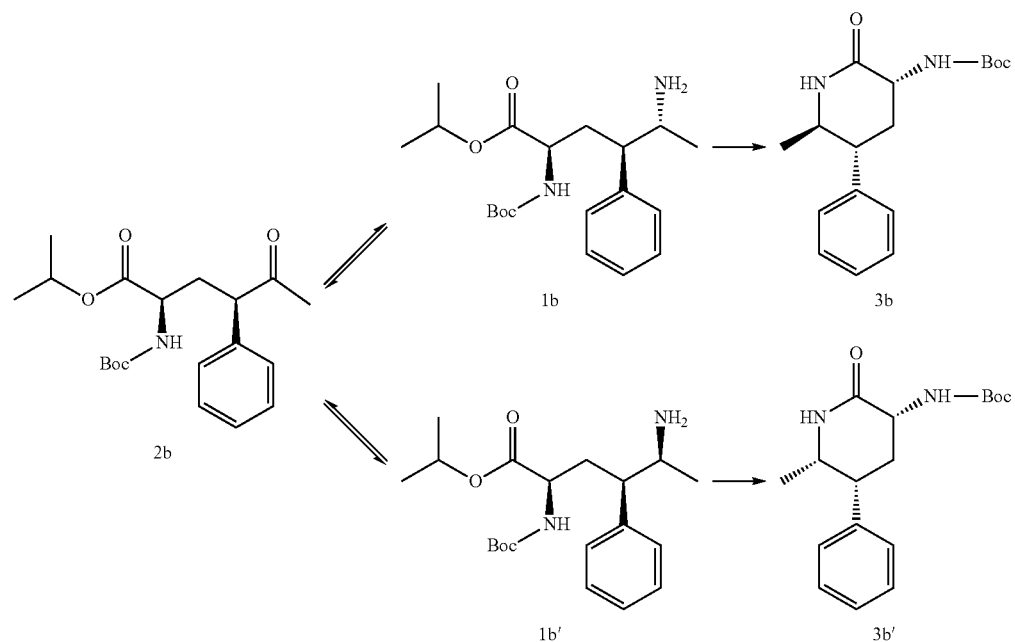

-continued

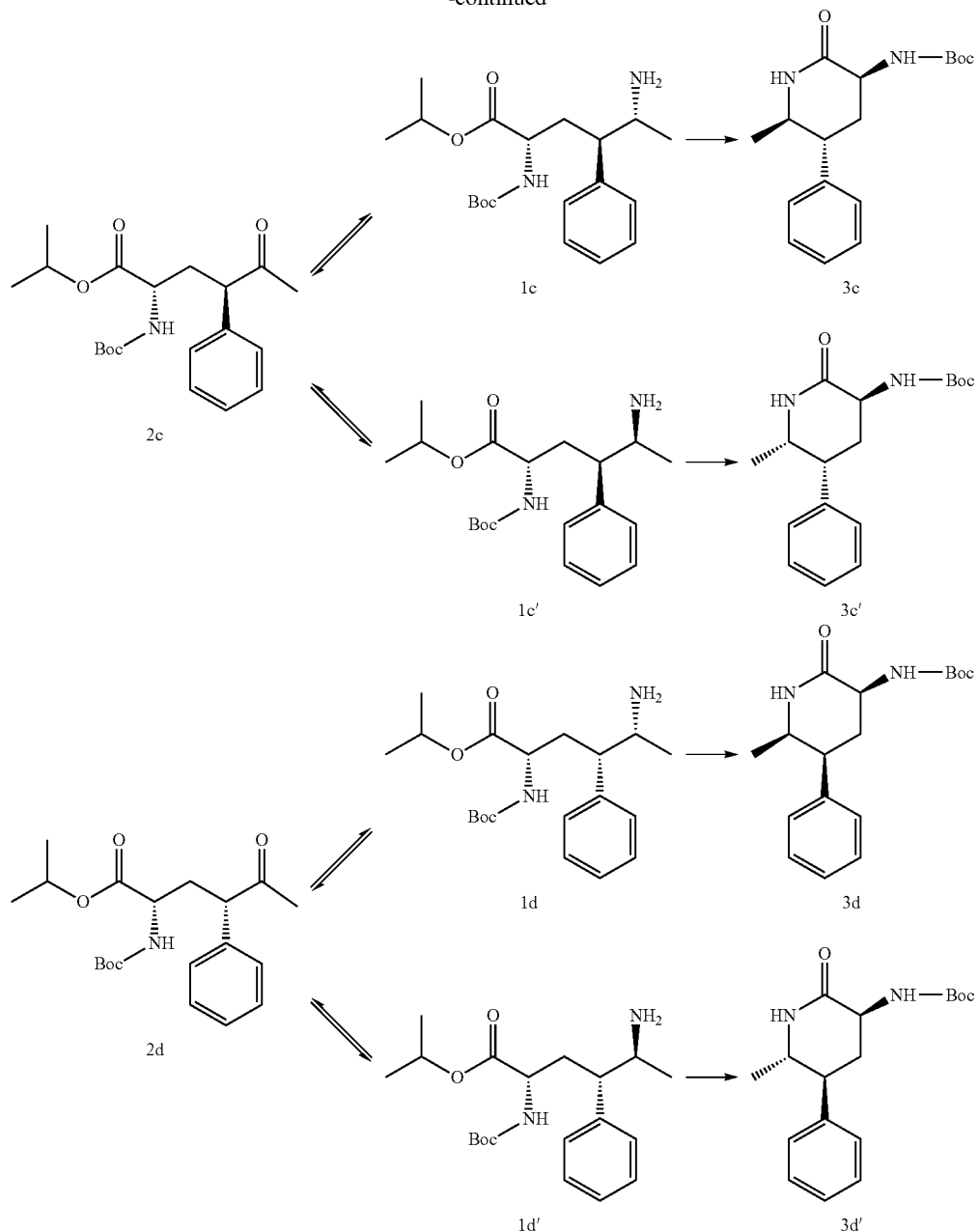

Transamination by the enzyme can then result in the formation of at least eight corresponding stereomeric forms of compound 1 (compounds 1a to 1d and 1a' to 1d'). Subsequent cyclization of the amine product can further produce different stereoisomers of the lactam compounds 3a to 3d and 3a' to 3d'. As used herein, a reference to compound 2 or its analogs without any specified stereomeric structure refers to any mixtures or pure preparations of the stereoisomeric forms of the compound that are substrates for the engineered transaminases disclosed herein (e.g., compounds 2a, 2b, 2c, 2d). Similarly, a reference to compound 1 or its analogs without any indication of a specific stereomeric structure refers to any mixtures of the stereomeric forms of product compound 1 formed in the transaminase reaction (e.g., compounds 1a, 1a', 1b, 1b', 1c, 1c', 1d, 1d'), while a reference to compound 3 or its analogs refers to any mixtures of the stereomeric forms of cyclic products of compound 3 (e.g., compounds 3a to 3d and 3a' to 3d') formed through cyclization of compound 1.

The engineered polypeptides of the disclosure are non-naturally occurring transaminases engineered to have improved properties, such as increased stereoselectivity, as compared to the wild-type *Arthrobacter* sp. KNK168 polypeptide of SEQ ID NO:2. The engineered transaminase polypeptides are adapted for efficient conversion of compound 2 to compound 1 and have one or more residue differences as compared to the reference engineered transaminase polypeptide of SEQ ID NO: 4 (which has 24 amino acid differences relative to the wild-type). These residue differences are associated with improvements in enzyme properties, particularly increased activity, increased stereoselectivity, increased stability, and tolerance of increased substrate and/or product concentration (e.g., decreased product inhibition).

In some embodiments, the engineered transaminase polypeptides are capable of converting the substrate compound 2 to compound 1 with an activity that is increased at least about 1.2 fold, 1.5 fold, 2 fold, 3 fold, 4 fold, 5 fold, 10 fold, 20 fold, 30 fold, 40 fold, 50 fold, 100 fold, 200 fold, 500 fold, 1000 fold or more relative to the activity of the reference polypeptide of SEQ ID NO: 4 under suitable reaction conditions. In some embodiments, the engineered transaminase polypeptides are capable of converting the substrate of compound 2 to compound 1 with a percent conversion of at least about 40%, at least about 50%, at least about 60%, at least about 70%, at least about 80%, or at least about 90%, at least about 95%, at least about 98%, at least about 99%, in a reaction time of about 48 h, about 36 h, about 24 h, or even shorter length of time, under suitable reaction conditions.

As described above, the cyclization of compound 1 to form compound 3 can occur readily under reaction conditions such that the engineered enzymes are capable of acting on substrate compound 2 for producing compound 3 in at least about 1.2 fold, 1.5 fold, 2 fold, 3 fold, 4 fold, 5 fold, 10 fold, 20 fold, 30 fold, 40 fold, 50 fold, 100 fold, 200 fold, 500 fold, 1000 fold or more relative to the activity of the reference polypeptide of SEQ ID NO: 4. In some embodiments, the engineered transaminase polypeptides are capable of acting on substrate compound 2 for producing compound 3 with a percent conversion of at least about 40%, at least about 50%, at least about 60%, at least about 70%, at least about 80%, or at least about 90%, at least about 95%, at least about 98%, at least about 99%, in a reaction time of about 48 h, about 36 h, about 24 h, or even shorter length of time, under suitable reaction conditions.

In some embodiments, the engineered transaminase polypeptides described herein exhibit diastereoselectivity for compound 1a and compound 1d over compounds 1b and compound 1c. In some embodiments, the engineered transaminase polypeptides are capable of converting compound 2 to compound 1a and compound 1d (i.e., [1a+1d]) in a diastereomeric ratio greater than 8:1 over compound 1b and compound 1c (i.e., [1b+1c]).

1d

1a

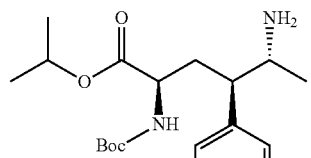

1b

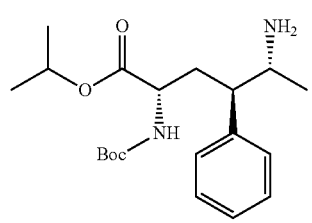

1c

In some embodiments, the engineered transaminase polypeptides are capable of converting compound 2 to compound 1a and compound 1d (i.e., [1a+1d]) in a diastereomeric ratio greater than 10:1, 20:1, 30:1, 40:1, 50:1, 60:1, 70:1, 80:1, 90:1, or 100:1 or greater over compound 1b and compound 1c (i.e., [1b+1c]).

In some embodiments, the engineered transaminase polypeptides are capable of acting on compound 2 for preparing compound 3a and compound 3d (i.e., [3a+3d]) in a diastereomeric ratio greater than 8:1 over compound 3b and compound 3c (i.e., [3b+3c]). In some embodiments, the engineered transaminase polypeptides are capable of acting on compound 2 for preparing compound 3a and compound 3d (i.e., [1a+1d]) in a diastereomeric ratio greater than 10:1, 20:1, 30:1, 40:1, 50:1, 60:1, 70:1, 80:1, 90:1, 100:1 or greater over compound 3b and compound 3c (i.e., [3b+3c]).

In some embodiments, the engineered transaminase polypeptides described herein exhibit diastereoselectivity for compound 1d over compound 1a.

Accordingly, in some embodiments, the engineered transaminases are capable of converting compound 2 to compound 1d in diastereomeric excess over compound 1a. In some embodiments, the engineered transaminases are capable of converting compound 2 to compound 1d in diastereomeric excess of greater than 10%, 20%, 30%, 40%, 50%, 60%, 70%, 80%, 90% or greater over compound 1a under suitable reaction conditions.

The exemplary engineered polypeptides associated with their improved properties for conversion of compound 2 to compound 1 include one or more residue differences as compared to SEQ ID NO:4 at the following residue positions: X2; X4; X5; X6; X8; X9; X10; X12; X13; X17; X18; X21; X22; X25; X27; X28; X29; X30; X31; X34; X37; X42; X43; X46; X47; X48; X49; X50; X52; X54; X55; X56; X61; X62; X64; X66 X68; X69; X72; X80; X81; X84; X85; X88; X97; X99; X101; X102; X103; X106; X107; X108; X115; X117; X120; X122; X124; X126; X127; X128; X131; X132; X134; X136; X139; X140; X141; X142; X143; X144; X146; X150; X152; X155; X156; X157; X159; X160; X161; X165; X168; X176; X179; X185; X190; X191; X192; X196; X199; X208; X209; X210; X215; X217; X223; X227; X231; X233; X234; X241; X256; X260; X263; X265; X266; X267; X269; X270; X273; X274; X282; X284; X295; X296; X297; X300; X305; X308; X309; X311; X312; X316; X319; X320; X323; X324; X325; X327; and X329. The specific amino acid differences at each of these positions that are associated with the improved properties of the exemplary polypeptides of Tables 2A, 2B, 2C, 2D, 2E, 2F, 2G, 2H, and 2I include: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X10L; X12H; X13A, X13F; X17L; X18I; X21L; X22A, X22H; X25A; X27L, X27H, X27P; X28N; X29N, X29T; X30F, X30G; X31H, X31R; X34V; X42G; X43S; X47R; X48G, X48R, X48S, X48W; X49I, X49P; X50S; X52H; X54A, X54L, X54M, X54P, X54R; X56D, X56E, X56W; X61G; X61W; X62A, X62L, X62N, X62S; X64C; X66A, X66S; X68I; X69A, X69G, X69T; X72A; X80Q; X84T; X85L; X88W; X97P; X102T, X102W; X103G, X103N; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X134G, X134L, X134S, X134V, X134Y, X134W; X136F, X136K, X136L, X136M, X136Y; X139E; X140A, X140K, X140M, X140T; X142M; X143V; X146R; X150L; X150S; X152A, X152C, X152F, X152G, X152I, X152L, X152R, X152S, X152W; X155C, X155I, X155L, X155T; X156A, X156F, X156S, X156T; X157L; X159G; X160L; X161M; X165N; X168R; X176C; X179K; X185A; X190M; X191A, X191G, X191S; X192A, X192G, X192H, X192K, X192N, X192Q, X192R, X192S; X196L, X196V; X199L, X199V; X208K; X209F, X209M, X209Q, X209V; X210G, X210S; X215F, X215H, X215L; X223A, X223S, X223T, X223V; X227I; X231T; X233D; X234L; X241R; X265Y, X265W; X266N; X267V; X269L, X269T; X270R; X273D, X273H, X273M, X273R, X273V; X274F, X274L, X274R, X274T; X282I, X282L, X282T, X282V; X284A, X284P, X284S, X284T, X284V; X295N, X295S; X296D, X296R, X296S, X296W; X300G, X300L; X305Q; X308A; X309W, X309L; X311T; X312C, X312M; X316L, X316R; X319R, X319T, X319Y; X320G, X320Q; X323C, X323E, X323R; X324Q; X325M, X325P, X325Q, X325V; X327L; and X329P.

In some embodiments, the engineered transaminases are capable of acting on compound 2 for preparing compound 3d in diastereomeric excess over compound 3a:

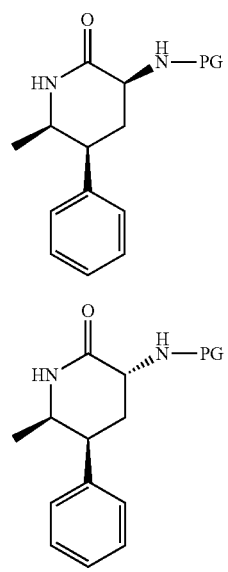

In some embodiments, the engineered transaminases are capable of acting on compound 2 for preparing compound 3d in diastereomeric excess of greater than 10%, 20%, 30%, 40%, 50%, 60%, 70%, 80%, 90% or greater over compound 3a under suitable reaction conditions.

In some embodiments, the engineered transaminase polypeptides described herein exhibit diastereoselectivity for compound 1a over compound 1d.

Accordingly, in some embodiments, the engineered transaminases are capable of converting compound 2 to compound 1a in diastereomeric excess over compound 1d. In some embodiments, the engineered transaminases are capable of converting compound 2 to compound 1a in diastereomeric excess of greater than 10%, 20%, 30%, 40%, 50%, 60%, 70%, 80%, 90% or greater over compound 1d under suitable reaction conditions.

In some embodiments, the engineered transaminases are capable of converting compound 2 to compound 1 for preparing compound 3a in diastereomeric excess over compound 3d.

In some embodiments, the engineered transaminases are capable of acting on compound 2 for preparing compound 3a in diastereomeric excess of greater than 10%, 20%, 30%, 40%, 50%, 60%, 70%, 80%, 90% or greater over compound 3d under suitable reaction conditions.

In some embodiments, the engineered transaminase polypeptides are capable of converting compound 2 to compound 1 with increased tolerance for the presence of substrate relative to the reference polypeptide of SEQ ID NO: 4 under suitable reaction conditions. Accordingly, in some embodiments the engineered transaminase polypeptides are capable of converting the substrate of compound 2 to compound 1 in the presence of a substrate loading concentration of at least about 1 g/L, 5 g/L, 10 g/L, 20 g/L, about 30 g/L, about 40 g/L, about 50 g/L, about 70 g/L, about 100 g/L, with a percent conversion of at least about 40%, at least about 50%, at least about 60%, at least about 70%, at least about 80%, at least about 90%, at least about 95%, at least about 98%, or at least about 99%, in a reaction time of about 72 h, about 48 h, about 36 h, about 24 h, or even shorter length of time, under suitable reaction conditions.

The suitable reaction conditions under which the above-described improved properties of the engineered polypeptides can be determined with respect concentrations or amounts of polypeptide, substrate, amine donor, cofactor, buffer, co-solvent, pH, and/or conditions including temperature and reaction time. In some embodiments, the suitable reaction conditions comprise 200 µL total volume, 5 g/L of compound 2, 100 µL cell lysate comprising the polypeptide, 1 M isopropylamine (IPM), 1 g/L PLP, 20% (v/v) DMSO, 0.2 M borate, pH 10.5, 45° C. and 24 h or 72 h reaction time. In some embodiments, the suitable reaction conditions comprise 5 g/L substrate of the mixture of compound 2, 5 g/L shake flask powder (SFP) of the polypeptide, 1 M isopropylamine, 1 g/L PLP, 0.2 M borate buffer, 20% (v/v) DMSO, pH 10.5, 45° C. and 24 h or 72 h reaction time.

Structure and function information for exemplary non-naturally occurring, engineered transaminase polypeptides of the present disclosure are shown below in Tables 2A, 2B, 2C, 2D, 2E, 2F, 2G, 2H, and 2I. The odd numbered sequence identifiers (i.e., SEQ ID NO) refer to the nucleotide sequence encoding the amino acid sequence provided by the even numbered SEQ ID NOs, and the sequences are provided in the electronic sequence listing file accompanying this disclosure, which is hereby incorporated by reference herein. The amino acid residue differences are based on comparison to the reference polypeptide sequence of SEQ ID NO: 4, which is an engineered transaminase polypeptide having the following 24 amino acid differences relative to the naturally occurring transaminase of *Arthrobacter* sp. KNK168 (SEQ ID NO: 2):

S8P; Y60F; L61Y; H62T; V65A; D81G; M94I; I96L; F122I; S124I; G136W; A169L; V199I; A209L; G215C; G217N; S223P; L269P; L273Y; T282S; A284G; P297S; I306V; and S321P. As described herein, while the transaminase reaction produces compound 1 in the various stereomeric forms in presence of an amino donor, the facile cyclization of compound 1 to compound 3 under the reaction conditions means that the activity relative to SEQ ID NO:4 for the conversion of compound 2 to compound 1 can be assessed by measuring the formation of compound 3 in its various stereomeric forms. In the present disclosure, the activity relative to SEQ ID NO:4 is determined based on the amount in mg/L of compound 3a and compound 3d formed per hour per g/L of the transaminase polypeptide tested under the specified reaction conditions. The "diastereomeric ratio" (also referred to herein as "d.r.") is the ratio of the two possible diastereomer products compound 3a and compound 3d to the two possible diastereomer products compound 3b and compound 3c. The diastereomeric ratio can be calculated from the formula, [3a+3d]/[3b+3c]. The % d.e. refers to the percentage of diastereomeric compound 3d formed in excess of compound 3a and is calculated based on the following formula: ([3d]−[3a])/([3d+[3a]).

In the screening of transaminases, the engineered polypeptide of SEQ ID NO: 4 was found to convert compound 2 to compound 1a and compound 1d with a d.r. of 8 and a % d.e. of 77%. The engineered polypeptide of SEQ ID NO:4 was used as the starting point for the further evolution of engineered polypeptides that had increased activity in converting compound 2 to compound 1a and compound 1d, and higher d.r. relative to SEQ ID NO:4. The activity of each engineered polypeptide was determined using a high-throughput (HTP) assay (as a primary screen), and, in some cases, a secondary shake-flask powder (SFP) and/or downstream processed (DSP) powder assay. The HTP assay values provided in Tables 2A, 2B, 2E, 2F, 2G, and 2H, were determined using *E. coli* clear cell lysates in 96 well-plate format following assay reaction conditions as noted in the Tables. The SFP and DSP enzyme preparations provide a more purified powder preparation of the engineered polypeptides. The SFP assay values in Tables 2C and 2I were determined using SFP of the engineered polypeptides in a 2 mL vial format using reaction conditions noted in the table. The DSP assay values in Tables 2D and 2I were determined using DSP powders of the engineered polypeptides in a 2 mL or 5 mL vial format using reaction conditions noted in the table. Further details of the HTP, SFP, and DSP preparations and assays are described in the Examples.

TABLE 2A

| SEQ ID NO: (nt/aa) | Amino Acid Differences (relative to SEQ ID NO: 4) | HTP Assay Activity (relative to SEQ ID NO: 4) |
|---|---|---|
| 3/4 | — | 1.0[1] |
| 5/6 | T62N | 5.9[1] |
| 7/8 | V69T | 3.5[1] |
| 9/10 | I124W; P327L | 7.0[1] |
| 11/12 | S126A; V152A | 3.1[1] |
| 13/14 | W136L | 78.7[1] |
| 15/16 | W192A | 111.3[1] |
| 17/18 | W192N | 48.6[1] |
| 19/20 | W192S | 82.8[1] |
| 21/22 | G284V | 57.7[1] |
| 23/24 | L209M; D300G | 34.4[1] |
| 25/26 | W136L; W192A | |
| 27/28 | I122F; I124F; W136L; V152F; L209M; G284V | 992.9[2] |
| 29/30 | T62N; I124F; S126A; W136L | 995.6[2] |
| 31/32 | I124F; S126A; W136L; V152A; W192S; G284V | 770.3[2] |
| 33/34 | I124W; S126A; W136L; W192A | 1233.9[2] |
| 35/36 | T62A; W192A | 333.8[3] |
| 37/38 | I124L; W192A | 701.0[3] |
| 39/40 | I124K; W192A | 712.1[3] |
| 41/42 | W192A; C215H; I311T | 378.3[3] |
| 43/44 | W192A; G284T | 395.9[3] |
| 45/46 | W136F; W192A | 194.8[3] |
| 47/48 | I122F; I124W; F160L; W192A; L209M; G284V | 805.8[3] |
| 49/50 | I122W; I124F; W192A; L209M; G284V | 1318.0[3] |
| 51/52 | I122W; I124F; S126A; W192A; G284V | 1122.7[3] |
| 53/54 | I124F; S126A; W192A | 894.4[3] |
| 55/56 | I124W; S126A; W136L; H143V; Y150S; W156T; P159G; W192A; C215H; P223S; V227I | 2644.3[3] |
| 57/58 | S54P; F56E; D64C; I124W; S126A; W136L; D139E; I140K; H143V; Y150S; W156T; W192A; C215H | 7.4[3] |
| 59/60 | I124W; S126A; W136L; I140K; H143V; Q155I; W156T; I157L; W192A; I199V; C215H; P223S; V227I; K231T | 445.4[3] |
| 61/62 | I124W; S126A; W136L; I140K; Y150S; Q155I; W192A; I196L; C215H; V227I; | 1908.9[3] |
| 63/64 | S54P; D64C; I124W; S126A; W136L; Q155I; W156T; I157L; W192A; C215H | 2845.4[3] |
| 65/66 | S54P; D64C; I124W; S126A; D139E; H143V; Q155I; I157L; P159G; W192A; I199V; C215H; V227I | 5465.0[3] |
| 67/68 | S54L; D64C; I124W; S126A; W136L; W192A; C215H | 1885.4[3] |
| 69/70 | S54L; I124W; S126A; W136L; W192A; C215H; P223S | 2838.0[3] |
| 71/72 | S54L; I124W; S126A; W136L; Q155I; W156T; I157L; W192A; C215H; P223S | 2815.8[3] |
| 73/74 | I124W; S126A; W136F; W192A | 1694.2[3] |
| 75/76 | I124W; S126A; W136L; V152W; W192A | 1019.2[3] |

TABLE 2A-continued

| SEQ ID NO: (nt/aa) | Amino Acid Differences (relative to SEQ ID NO: 4) | HTP Assay Activity (relative to SEQ ID NO: 4) |
|---|---|---|
| 77/78 | I124W; S126A; W136L; V152I; W192A | 1469.6[3] |
| 79/80 | I124W; S126A; W136L; V152L; W192A | 1068.6[3] |
| 81/82 | I124W; S126A; W136L; W192S | 1996.5[3] |
| 83/84 | I124W; S126A; W136L; W192A; G284A | 1949.6[3] |
| 85/86 | T13A; R52H; T128A; V152L; E208K; L325P | 3.8[1] |
| 87/88 | T62N; D165N | 2.3[1] |
| 89/90 | Y12H; L80Q; T134S; R176C | 1.8[1] |
| 91/92 | Y61W | 1.1[1] |
| 93/94 | Y61G | 1.2[1] |
| 95/96 | T62S | 2.1[1] |
| 97/98 | T62L | 2.1[1] |
| 99/100 | V69A | 1.5[1] |
| 101/102 | I122F; H168R | 3.7[1] |
| 103/104 | I122W | 4.8[1] |
| 105/106 | I122Y | 3.2[1] |
| 107/108 | I122F | 5.7[1] |
| 109/110 | I124K | 2.9[1] |
| 111/112 | I124N | 1.6[1] |
| 113/114 | I124L; | 2.6[1] |
| 115/116 | I124F | 4.2[1] |
| 117/118 | S126A | 1.6[1] |
| 119/120 | S126I | 1.8[1] |
| 121/122 | W136M | 41.9[1] |
| 123/124 | I84T; W136L | 57.6[1] |
| 125/126 | W136Y | 3.8[1] |
| 127/128 | W136K | 2.5[1] |
| 129/130 | Y150L | 2.1[1] |
| 131/132 | V152F | 2.0 |
| 133/134 | V152W | 1.7[1] |
| 135/136 | W192H | 20.4[1] |
| 137/138 | W192G | 34.6[1] |
| 139/140 | W192Q | 26.1[1] |
| 141/142 | W192K | 9.5[1] |
| 143/144 | W192R | 12.5[1] |
| 145/146 | G284P | 12.1[1] |
| 147/148 | G284S | 2.0[1] |
| 149/150 | G284A | 5.1[1] |
| 151/152 | L209Q | 6.0[1] |
| 153/154 | L209M | 34.1[1] |
| 155/156 | E42G; I122F; Y150S | 5.3[1] |
| 157/158 | I122F; V152C; P223S | 3.1[1] |
| 159/160 | I122M; P223S | 2.3[1] |
| 161/162 | I122M; V152C; W192G | 79.9[1] |
| 163/164 | I122F; Y150S; P223S; G284A | 94.3[1] |
| 165/166 | I122F; I196L; I199V; S282V; G284V | 1.5[1] |
| 167/168 | P223V | 3.4[1] |
| 169/170 | I196L; L209V; S282I | 1.9[1] |
| 171/172 | T68I; I122F; I196V; I199L; P223T; S282L; G284V; E320G | 2.0[1] |
| 173/174 | I122F; N296D | 1.7[1] |
| 175/176 | I199V; L209V | 1.8[1] |
| 177/178 | I122F; P223V; G284A | 9.3[1] |
| 179/180 | I122F; L209F; | 4.6[1] |
| 181/182 | I124W; S126A; W136L; W192S; G284V; R312C | 479.0[2] |
| 183/184 | I124W; S126A; I127T; W136L; V152F; W192S; G284V | 359.5[2] |
| 185/186 | I122F; I124W; W136L; V152A; W192N; L209M; G284V | 258.8[2] |
| 187/188 | I124W; W136L; W192S | 442.4[2] |
| 189/190 | I124F; S126A; W136L; V152F; W192A; G284V | 474.8[2] |
| 191/192 | I122F; I124W; S126A; W136L; V152F; W192A; G284V | 347.9[2] |
| 193/194 | I124W; W136L; V152F; W192A; G284V | 295.4[2] |
| 195/196 | I122F; I124F; S126A; W136L; V152A; W192N; L209M; G284V | 254.5[2] |
| 197/198 | I124W; W136L; W192A | 555.7[2] |
| 199/200 | D103G; I124W; W136L; W192A; L209M; G284V | 404.3[2] |
| 201/202 | I124W; W136L; W192A; Y273H | 452.2[2] |
| 203/204 | I124W; W136L; W192S; G284V; G295S | 322.2[2] |
| 205/206 | I124W; W136L; W192A; G284V | 354.9[2] |
| 207/208 | I124W; W136L; W192S; G284V | 700.1[2] |
| 209/210 | I124R; W192A | 329.9[3] |
| 211/212 | I124F; W192A; D266N | 370.5[3] |
| 213/214 | V72A; I124K; W192A | 198.2[3] |
| 215/216 | I124S; W192A | 263.4[3] |
| 217/218 | I124M; W192A | 413.6[3] |
| 219/220 | S126I; W192A | 160.0[3] |
| 221/222 | S126A; W192A | 169.1[3] |
| 223/224 | S126T; W192A | 200.2[3] |
| 225/226 | S126C; W192A | 201.3[3] |

TABLE 2A-continued

| SEQ ID NO: (nt/aa) | Amino Acid Differences (relative to SEQ ID NO: 4) | HTP Assay Activity (relative to SEQ ID NO: 4) |
|---|---|---|
| 227/228 | V152G; W192A; | 212.5[3] |
| 229/230 | V152A; W192A; | 283.4[3] |
| 231/232 | V152S; W192A; | 210.6[3] |
| 233/234 | W192A; C215H | 338.4[3] |
| 235/236 | W192A; C215L | 191.7[3] |
| 237/238 | W192A; V227I | 228.4[3] |
| 239/240 | V69T; W192A | 280.7[3] |
| 241/242 | V69G; W192A | 133.9[3] |
| 243/244 | T13F; S54A; W192A | 154.4[3] |
| 245/246 | S54R; W192A | 354.6[3] |
| 247/248 | I157L; W192A; | 215.4[3] |
| 249/250 | Q155L; W192A | 159.3[3] |
| 251/252 | Q155I; W192A | 187.4[3] |
| 253/254 | H143V; W192A | 158.0[3] |
| 255/256 | W156T; W192A | 248.2[3] |
| 257/258 | P159G; W192A | 175.7[3] |
| 259/260 | I140K; W192A; L324Q; L325V | 151.8[3] |
| 261/262 | S54P; W192A | 612.0[3] |
| 263/264 | F56D; W192A | 182.2[3] |
| 265/266 | F56E; W192A | 215.4[3] |
| 267/268 | Q155T; W192A | 174.0[3] |
| 269/270 | W156A; W192A | 231.7[3] |
| 271/272 | W156S; W192A | 247.9[3] |
| 273/274 | D139E; W192A | 152.0[3] |
| 275/276 | V152A; W192A; L209M; G284V | 526.4[3] |
| 277/278 | V152F; W192A; L209M; G284V | 714.8[3] |
| 279/280 | I122W; I124W; W192A | 451.4[3] |
| 281/282 | I122W; I124W; S126A; W192A; L209M; G284V | 660.2[3] |
| 283/284 | K115R; E117V; V152A; W192A; L209M; G284V | 373.8[3] |
| 285/286 | I122W; I124W; W192A; L209M | 508.0[3] |
| 287/288 | I124W; W192A; L209M; I267V | 428.0[3] |
| 289/290 | I124F; W136L; V152F; W192A; G284V | 518.1[3] |
| 291/292 | D64C; I124W; S126A; W136L; D139E; W192A; I199V; C215H | 2364.2[3] |
| 293/294 | S54L; D64C; I124W; S126A; W136L; I140K; W192A; I199V; C215H; V227I | 1288.2[3] |
| 295/296 | I124W; S126A; W136L; Q155I; I157L; W192A; I199V; C215H; | 3149.0[3] |
| 297/298 | S54P; D64C; I124W; S126A; W136L; H143V; I157L; P159G; W192A; I199V; C215H; P269L | 2313.6[3] |
| 299/300 | S54L; D64C; I124W; S126A; W136L; Q155I; W156T; I157L; W192A; V227I | 2206.3[3] |
| 301/302 | I124W; S126A; W136L; W192A; I199V; C215H | 2421.0[3] |
| 303/304 | I124W; S126A; W136L; V152R; W192A | 834.1[3] |

HTP assay conditions:
[1]Cells were lysed by shaking for 1 h at 250 rpm and room temperature in 150 μL of lysis buffer containing 0.2M borate, 0.5 g/L lysozyme, and 0.4 g/L polymyxin B sulfate at pH 10.5. 5 g/L of compound 2, 100 μL clear cell lysate (of cells containing the transaminase polypeptide lysed in 150 μL of lysis buffer), 20% (v/v) DMSO, 1M isopropylamine (IPM), 1 g/L PLP, 0.2M borate, pH 10.5, 45° C. and 24 h.
[2]Cells were lysed by shaking for 1 h at 250 rpm and room temperature in 300 μL of lysis buffer containing 0.2M borate, 0.5 g/L lysozyme, and 0.4 g/L polymyxin B sulfate at pH 10.5. 5 g/L of compound 2, 100 μL clear cell lysate (of cells containing the transaminase polypeptide lysed in 300 μL of lysis buffer), 20% (v/v) DMSO, 1M isopropylamine (IPM), 1 g/L PLP, 0.2M borate, pH 10.5, 45° C. and 24 h.
[3]Cells were lysed by shaking for 1 h at 250 rpm and room temperature in 150 μL of lysis buffer containing 0.2M borate, 0.5 g/L lysozyme, and 0.4 g/L polymyxin B sulfate at pH 10.5. 5 g/L of compound 2, 40 μL clear cell lysate (of cells containing the transaminase polypeptide lysed in 300 μL of lysis buffer), 20% (v/v) DMSO, 1M isopropylamine (IPM), 1 g/L PLP, 0.2M borate, pH 10.5, 45° C. and 24 h.

TABLE 2B

| SEQ ID NO: (nt/aa) | Amino Acid Differences (relative to SEQ ID NO: 4) | HTP Assay Activity[1] (relative to SEQ ID NO: 34) | HTP Assay Activity[2] (relative to SEQ ID NO: 34) |
|---|---|---|---|
| 55/56 | I124W; S126A; W136L; H143V; Y150S; W156T; P159G; W192A; C215H; P223S; V227I | 2.1 | 2.2 |
| 71/72 | S54L; I124W; S126A; W136L; Q155I; W156T; I157L; W192A; C215H; P223S | 2.3 | 1.8 |
| 61/62 | I124W; S126A; W136L; I140K; Y150S; Q155I; W192A; I196L; C215H; V227I; | 1.5 | 1.0 |
| 63/64 | S54P; D64C; I124W; S126A; W136L; Q155I; W156T; I157L; W192A; C215H | 2.3 | 1.2 |
| 65/66 | S54P; D64C; I124W; S126A; D139E; H143V; Q155I; I157L; P159G; W192A; I199V; C215H; V227I | 4.4 | 1.4 |
| 67/68 | S54L; D64C; I124W; S126A; W136L; W192A; C215H | 1.5 | 0.8 |

TABLE 2B-continued

| SEQ ID NO: (nt/aa) | Amino Acid Differences (relative to SEQ ID NO: 4) | HTP Assay Activity[1] (relative to SEQ ID NO: 34) | HTP Assay Activity[2] (relative to SEQ ID NO: 34) |
|---|---|---|---|
| 69/70 | S54L; I124W; S126A; W136L; W192A; C215H; P223S | 2.3 | 2.4 |
| 73/74 | I124W; S126A; W136F; W192A | 1.4 | 0.6 |
| 75/76 | I124W; S126A; W136L; V152W; W192A; | 0.8 | 2.2 |
| 77/78 | I124W; S126A; W136L; V152I; W192A; | 1.2 | 1.3 |
| 79/80 | I124W; S126A; W136L; V152L; W192A; | 0.9 | 2.0 |
| 81/82 | I124W; S126A; W136L; W192S; | 1.6 | 1.0 |
| 83/84 | I124W; S126A; W136L; W192A; G284A; | 1.6 | 1.4 |
| 291/292 | S126I; W192A | 1.9 | 1.0 |
| 293/294 | S54L; D64C; I124W; S126A; W136L; I140K; W192A; I199V; C215H; V227I | 1.0 | 1.1 |
| 295/296 | I124W; S126A; W136L; Q155I; I157L; W192A; I199V; C215H; | 2.6 | 1.3 |
| 297/298 | S54P; D64C; I124W; S126A; W136L; H143V; I157L; P159G; W192A; I199V; C215H; P269L | 1.9 | 0.8 |
| 299/300 | S54L; D64C; I124W; S126A; W136L; Q155I; W156T; I157L; W192A; V227I | 1.8 | 0.6 |
| 301/302 | I124W; S126A; W136L; W192A; I199V; C215H | 2.0 | 1.0 |
| 303/304 | I124W; S126A; W136L; V152R; W192A | 0.7 | 1.4 |

[1]HTP activity assay conditions: Cells were lysed by shaking for 1 h at 250 rpm and room temperature in 300 μL of lysis buffer containing 0.2 M borate, 0.5 g/L lysozyme, and 0.4 g/L polymyxin B sulfate at pH 10.5. Enzymatic reaction: 5 g/L of substrate compound 2, 40 μL clear cell lysate, 20% (v/v) DMSO, 1 M isopropylamine (IPM), 1 g/L PLP, 0.2 M borate, pH 10.5 at 45° C. for 24 h.

[2]HTP activity assay conditions: Cells were lysed by shaking for 1 h at 250 rpm and room temperature in 150 μL of lysis buffer containing 0.2 M borate, 0.5 g/L lysozyme, and 0.4 g/L polymyxin B sulfate at pH 10.5. Enzymatic reaction: 50 g/L of substrate compound 2, 40 μL clear cell lysate, 50% (v/v) DMSO, 1 M isopropylamine (IPM), 1 g/L PLP, 0.2 M borate, pH 10.5 at 45° C. for 24 h.

TABLE 2C

| SEQ ID NO: (nt/aa) | Amino Acid Differences (relative to SEQ ID NO: 4) | Activity (relative to SEQ ID NO: 4) | d.r. | % d.e. | SFP Reaction Conditions[1] |
|---|---|---|---|---|---|
| 3/4 | — | 1.0 | 8 | 77 | A |
| 5/6 | T62N | 6.0 | 81 | 55 | A |
| 7/8 | V69T | 2.7 | 0.2 | 50 | A |
| 9/10 | I124W; P327L | 3.5 | 49 | 43 | A |
| 11/12 | S126A; V152A | 6.2 | 18 | 31 | A |
| 13/14 | W136L | 23.7 | 27 | 53 | A |
| 13/14 | W136L | 23.5 | 32 | 49 | B |
| 15/16 | W192A | 126.0 | >100 | 0 | A |
| 15/16 | W192A | 164.5 | >100 | −24 | B |
| 17/18 | W192N | 51.2 | >100 | −10 | A |
| 19/20 | W192S | 84.0 | >100 | −6 | A |
| 21/22 | G284V | 11.7 | 55 | 85 | A |
| 23/24 | L209M; D300G | 8.0 | 88 | 77 | A |
| 25/26 | W136L; W192A | 145.3 | >100 | −5 | A |
| 27/28 | I122F; I124F; W136L; V152F; L209M; G284V | 109.0 | 6 | 90 | B |
| 29/30 | T62N; I124F; S126A; W136L | 171.0 | >100 | 40 | B |
| 31/32 | I124F; S126A; W136L; V152A; W192S; G284V | 365.5 | 55 | 4 | B |
| 33/34 | I124W; S126A; W136L; W192A | 307.0 | 90 | −3 | B |
| 35/36 | T62A; W192A | 163.0 | >100 | −2 | B |
| 37/38 | I124L; W192A | 369.0 | 43 | 1 | B |
| 39/40 | I124K; W192A | 331.0 | 27 | −1 | B |
| 41/42 | W192A; C215H; I311T | 271.0 | >100 | −12 | B |
| 43/44 | W192A; G284T; | 126.5 | 47 | 47 | B |
| 45/46 | W136F; W192A; | 240.5 | 95 | −20 | B |
| 47/48 | I122F; I124W; F160L; W192A; L209M; G284V; | 145.5 | >100 | 14 | B |
| 49/50 | I122W; I124F; W192A; L209M; G284V; | 201.5 | >100 | 33 | B |
| 51/52 | I122W; I124F; S126A; W192A; G284V; | 143.5 | >100 | 18 | B |
| 53/54 | I124F; S126A; W192A; | 315.0 | 17 | −1 | B |
| 33/34 | I124W; S126A; W136L; W192A; | 373.5 | >100 | −17 | C |
| 55/56 | I124W; S126A; W136L; H143V; Y150S; W156T; P159G; W192A; C215H; P223S; V227I; | 399.0 | 57 | −9 | C |
| 57/58 | S54P; F56E; D64C; I124W; S126A; W136L; D139E; I140K; H143V; Y150S; W156T; W192A; C215H; | 61.5 | >100 | −76 | C |
| 59/60 | I124W; S126A; W136L; I140K; H143V; Q155I; W156T; I157L; W192A; I199V; C215H; P223S; V227I; K231T; | 144.0 | 57 | −4 | C |

TABLE 2C-continued

| SEQ ID NO: (nt/aa) | Amino Acid Differences (relative to SEQ ID NO: 4) | Activity (relative to SEQ ID NO: 4) | d.r. | % d.e. | SFP Reaction Conditions[1] |
|---|---|---|---|---|---|
| 61/62 | I124W; S126A; W136L; I140K; Y150S; Q155I; W192A; I196L; C215H; V227I; | 375.0 | 65 | −13 | C |
| 63/64 | S54P; D64C; I124W; S126A; W136L; Q155I; W156T; I157L; W192A; C215H; | 432.0 | >100 | −13 | C |
| 65/66 | S54P; D64C; I124W; S126A; D139E; H143V; Q155I; I157L; P159G; W192A; I199V; C215H; V227I; | 475.5 | 30 | −4 | C |
| 67/68 | S54L; D64C; I124W; S126A; W136L; W192A; C215H; | 417.0 | >100 | −26 | C |
| 69/70 | S54L; I124W; S126A; W136L; W192A; C215H; P223S; | 522.0 | 41 | −9 | C |
| 71/72 | S54L; I124W; S126A; W136L; Q155I; W156T; I157L; W192A; C215H; P223S; | 336.0 | 44 | −8 | C |
| 73/74 | I124W; S126A; W136F; W192A; | 660.0 | 68 | −9 | C |
| 75/76 | I124W; S126A; W136L; V152W; W192A; | 424.5 | >100 | −19 | C |
| 77/78 | I124W; S126A; W136L; V152I; W192A; | 570.0 | >100 | −10 | C |
| 79/80 | I124W; S126A; W136L; V152L; W192A; | 483.0 | >100 | −17 | C |
| 81/82 | I124W; S126A; W136L; W192S; | 481.5 | >100 | −9 | C |
| 83/84 | I124W; S126A; W136L; W192A; G284A; | 682.5 | >100 | 0 | C |

[1]SFP reaction conditions:
A: In a 2 mL vial: 5 g/L of substrate compound 2, 15 g/L SFP of transaminase polypeptide, 20% (v/v) DMSO, 1 M isopropylamine (IPM), 1 g/L PLP, 0.2 M borate, pH 10.5, 45° C. and 72 h.
B: In a 2 mL vial: 5 g/L of substrate compound 2, 15 g/L SFP of transaminase polypeptide, 20% (v/v) DMSO, 1 M isopropylamine (IPM), 1 g/L PLP, 0.2 M borate, pH 10.5, 45° C. and 24 h.
C: In a 2 mL vial: 5 g/L of substrate compound 2, 5 g/L SFP of transaminase polypeptide, 20% (v/v) DMSO, 1 M isopropylamine (IPM), 1 g/L PLP, 0.2 M borate, pH 10.5, 45° C. and 24 h.

TABLE 2D

| SEQ ID NO: (nt/aa) | Amino Acid Differences (relative to SEQ ID NO: 4) | Activity[1] relative to SEQ ID NO: 4 | d.r. | % d.e. | DSP Reaction Conditions[1] |
|---|---|---|---|---|---|
| 3/4 | — | 1.0 | 12 | 71 | A |
| 13/14 | W136L; | 10.8 | 29 | 58 | A |
| 15/16 | W192A; | 59.5 | >100 | −5 | A |
| 25/26 | W136L; W192A; | 64.5 | >100 | −8 | A |
| 15/16 | W192A; | 65.8 | >100 | −42 | C |
| 31/32 | I124F; S126A; W136L; V152A; W192S; G284V; | 364.2 | 65 | 9 | C |
| 33/34 | I124W; S126A; W136L; W192A; | 490.2 | >100 | −6 | C |
| 37/38 | I124L; W192A; | 342.0 | 72 | −3 | C |
| 41/42 | W192A; C215H; I311T; | 163.4 | >100 | −30 | C |
| 43/44 | W192A; G284T; | 115.6 | 54 | 62 | C |
| 49/50 | I122W; I124F; W192A; L209M; G284V; | 222.2 | >100 | 42 | C |
| 51/52 | I122W; I124F; S126A; W192A; G284V; | 153.0 | >100 | 27 | C |
| 33/34 | I124W; S126A; W136L; W192A; | 720.0 | >100 | −39 | D |
| 61/62 | I124W; S126A; W136L; I140K; Y150S; Q155I; W192A; I196L; C215H; V227I; | 491.5 | 51 | −40 | D |
| 65/66 | S54P; D64C; I124W; S126A; D139E; H143V; Q155I; I157L; P159G; W192A; I199V; C215H; V227I; | 657.7 | 33 | −40 | D |
| 69/70 | S54L; I124W; S126A; W136L; W192A; C215H; P223S; | 283.8 | >100 | −59 | D |
| 71/72 | S54L; I124W; S126A; W136L; Q155I; W156T; I157L; W192A; C215H; P223S; | 602.3 | 16 | −36 | D |
| 73/74 | I124W; S126A; W136F; W192A; | 851.5 | 46 | −39 | D |
| 75/76 | I124W; S126A; W136L; V152W; W192A; | 581.5 | >100 | −31 | D |
| 81/82 | I124W; S126A; W136L; W192S; | 595.4 | >100 | −39 | D |
| 83/84 | I124W; S126A; W136L; W192A; G284A; | 1370.8 | >100 | −19 | D |

[1]DSP reaction conditions:
A: In a 2 mL vial: 5 g/L of substrate compound 2, 15 g/L DSP powder of transaminase polypeptide, 20% (v/v) DMSO, 1 M isopropylamine (IPM), 1 g/L PLP, 0.2 M borate, pH 10.5, 45° C. and 72 h.
C: In a 2 mL vial: 5 g/L of substrate compound 2, 5 g/L DSP powder of transaminase polypeptide, 20% (v/v) DMSO, 1 M isopropylamine (IPM), 1 g/L PLP, 0.2 M borate, pH 10.5, 45° C. and 24 h.
D: In a 5 mL vial: 50 g/L of substrate compound 2, 25 g/L DSP powder of transaminase polypeptide, 50% (v/v) DMSO, 1 M isopropylamine (IPM), 1 g/L PLP, 0.2 M borate, pH 10.5, 45° C. and 24 h.

TABLE 2E

| SEQ ID NO: (nt/aa) | Amino Acid Differences (relative to SEQ ID NO: 4) | HTP Assay Activity[1] (relative to SEQ ID NO: 84) |
|---|---|---|
| 83/84 | I124W; S126A; W136L; W192A; G284A; | 1 |
| 305/306 | A2M; I124W; S126A; W136L; W192A; G284A; | 2.89 |
| 307/308 | A5T; I124W; S126A; W136L; W192A; G284A; | 2.85 |
| 309/310 | E9F; I124W; S126A; W136L; W192A; G284A; | 2.18 |
| 311/312 | A5P; I124W; S126A; W136L; W192A; G284A; | 3.45 |
| 313/314 | D6F; I124W; S126A; W136L; W192A; G284A; | 2.19 |
| 315/316 | I10L; I124W; S126A; W136L; W192A; G284A; | 2.01 |
| 317/318 | A5N; I124W; S126A; W136L; W192A; G284A; | 4.45 |
| 319/320 | P8H; I124W; S126A; W136L; W192A; G284A; | 3.21 |
| 321/322 | A5I; I124W; S126A; W136L; W192A; G284A; | 5.41 |
| 323/324 | A5L; I124W; S126A; W136L; W192A; G284A; | 4.88 |
| 325/326 | S4L; I124W; S126A; W136L; W192A; G284A; | 3.42 |
| 327/328 | A5C; I124W; S126A; W136L; W192A; G284A; | 3.28 |
| 329/330 | D6S; I124W; S126A; W136L; W192A; G284A; | 5.38 |
| 331/332 | S4F; I124W; S126A; W136L; W192A; G284A; | 3.15 |
| 333/334 | E9L; I124W; S126A; W136L; W192A; G284A; | 1.98 |
| 335/336 | A5K; I124W; S126A; W136L; W192A; G284A; | 3.60 |
| 337/338 | E9I; I124W; S126A; W136L; W192A; G284A; | 2.02 |
| 339/340 | D6R; I124W; S126A; W136L; W192A; G284A; | 2.20 |
| 341/342 | E9Q; I124W; S126A; W136L; W192A; G284A; | 1.90 |
| 343/344 | S4Y; I124W; S126A; W136L; W192A; G284A; | 2.70 |
| 345/346 | D6T; I124W; S126A; W136L; W192A; G284A; | 3.17 |
| 347/348 | A5H; I124W; S126A; W136L; W192A; G284A; | 4.44 |
| 349/350 | A5Y; I124W; S126A; W136L; W192A; G284A; | 4.71 |
| 351/352 | A5F; I124W; S126A; W136L; W192A; G284A; | 5.51 |
| 353/354 | A5M; I124W; S126A; W136L; W192A; G284A; | 3.51 |
| 355/356 | A5V; I124W; S126A; W136L; W192A; G284A; | 2.17 |
| 357/358 | A5S; I124W; S126A; W136L; W192A; G284A; | 4.48 |
| 359/360 | T62A; I124W; S126A; W136L; W192A; G284A; | 1.49 |
| 361/362 | I124F; S126A; W136L; W192A; G284A; | 2.26 |
| 363/364 | W124L; S126A; W136L; W192A; G284A; | 1.68 |
| 365/366 | I124W; S126A; T134W; W136L; W192A; G284A; | 1.68 |
| 367/368 | I124W; S126A; W136F; W192A; G284A; | 1.73 |
| 369/370 | I124W; S126A; W136L; F190M; W192A; G284A; | 1.34 |
| 371/372 | I124W; S126A; W136L; W192A; C215F; G284A; | 3.30 |
| 373/374 | I124W; S126A; W136L; W192A; C215L; G284A; | 2.67 |
| 375/376 | I124W; S126A; W136L; W192A; C215H; G284A; | 2.55 |
| 377/378 | T22A; I124W; S126A; W136L; W192A; G284A; | 1.45 |
| 379/380 | I124W; S126A; W136L; W192A; A241R; G284A; | 4.57 |
| 381/382 | T22H; I124W; S126A; W136L; W192A; G284A; | 1.78 |
| 383/384 | I124W; S126A; W136L; W156S; W192A; G284A; | 1.77 |
| 385/386 | L181; I124W; S126A; W136L; W192A; G284A; | 2.47 |
| 387/388 | D25A; I124W; S126A; W136L; W192A; G284A; | 1.64 |
| 389/390 | G17L; I124W; S126A; W136L; W192A; G284A; | 2.81 |
| 391/392 | E27L; I124W; S126A; W136L; W192A; G284A; | 2.78 |
| 393/394 | P30G; I124W; S126A; W136L; W192A; G284A; | 2.13 |
| 395/396 | S54M; I124W; S126A; W136L; W192A; G284A; | 2.35 |
| 397/398 | A31H; I124W; S126A; W136L; W192A; G284A; | 2.69 |
| 399/400 | A31R; I124W; S126A; W136L; W192A; G284A; | 2.63 |
| 401/402 | L34V; I124W; S126A; W136L; W192A; G284A; | 1.71 |
| 403/404 | E27H; I124W; S126A; W136L; W192A; G284A; | 3.06 |
| 405/406 | D29N; I124W; S126A; W136L; W192A; G284A; | 1.79 |
| 407/408 | P30F; G43S; I124W; S126A; W136L; W192A; G284A; | 1.88 |
| 409/410 | D29T; I124W; S126A; W136L; W192A; G284A; | 2.03 |
| 411/412 | L28N; I124W; S126A; W136L; W192A; G284A; | 6.19 |
| 413/414 | E27P; I124W; S126A; W136L; W192A; G284A; | 2.46 |
| 415/416 | I124W; S126A; W136L; I140A; W192A; G284A; | 1.85 |
| 417/418 | I124W; S126A; W136L; W192A; P210G; G284A; | 1.97 |
| 419/420 | I124W; S126A; W136L; I140T; W192A; G284A; | 2.24 |
| 421/422 | I124W; S126A; W136L; H143V; W192A; G284A; | 2.01 |
| 423/424 | I124W; S126A; W136L; I140M; W192A; G284A; | 1.75 |
| 425/426 | S54R; I124W; S126A; W136L; W192A; G284A; | 2.72 |
| 427/428 | E50S; I124W; S126A; W136L; W192A; G284A; | 1.72 |
| 429/430 | S49I; I124W; S126A; W136L; W192A; G284A; | 1.37 |
| 431/432 | P47R; I124W; S126A; W136L; W192A; G284A; | 1.81 |
| 433/434 | I97P; I124W; S126A; W136L; W192A; G284A; | 1.31 |
| 435/436 | E85L; I124W; S126A; W136L; W192A; G284A; | 1.53 |
| 437/438 | Q102T; I124W; S126A; W136L; W192A; G284A; | 2.16 |
| 439/440 | F88W; I124W; S126A; W136L; W192A; G284A; | 1.61 |
| 441/442 | Q102W; I124W; S126A; W136L; W192A; G284A; | 2.83 |
| 443/444 | I124W; S126A; W136L; P179K; W192A; G284A; | 2.47 |
| 445/446 | I124W; S126A; W136L; D161M; W192A; G284A; | 1.84 |
| 447/448 | I124W; S126A; W136L; Q146R; W192A; G284A; | 1.62 |
| 449/450 | I124W; S126A; W136L; W192A; V234L; G284A; | 1.90 |
| 451/452 | I124W; S126A; W136L; W192A; G233D; Y273R; G284A; | 3.42 |

TABLE 2E-continued

| SEQ ID NO: (nt/aa) | Amino Acid Differences (relative to SEQ ID NO: 4) | HTP Assay Activity[1] (relative to SEQ ID NO: 84) |
|---|---|---|
| 453/454 | I124W; S126A; W136L; W192A; P269T; G284A; | 2.36 |
| 455/456 | I124W; S126A; W136L; W192A; D274L; G284A; | 2.02 |
| 457/458 | I124W; S126A; W136L; W192A; Y273R; G284A; | 3.29 |
| 459/460 | I124W; S126A; W136L; W192A; G284A; N296S; | 1.39 |
| 461/462 | I124W; S126A; W136L; W192A; G284A; N296W; | 2.76 |
| 463/464 | I124W; S126A; W136L; W192A; A265Y; G284A; | 1.70 |
| 465/466 | I124W; S126A; W136L; W192A; A265W; G284A; | 3.09 |
| 467/468 | I124W; S126A; W136L; W192A; Y273V; G284A; | 2.52 |
| 469/470 | I124W; S126A; W136L; W192A; A270R; G284A; | 2.97 |
| 471/472 | I124W; S126A; W136L; W192A; Y273D; G284A; | 2.33 |
| 473/474 | I124W; S126A; W136L; W192A; D274T; G284A; | 2.23 |
| 475/476 | I124W; S126A; W136L; W192A; G284A; N296R; | 2.49 |
| 477/478 | I124W; S126A; W136L; W192A; D274R; G284A; | 2.33 |
| 479/480 | I124W; S126A; W136L; W192A; D274F; G284A; | 2.51 |
| 481/482 | I124W; S126A; W136L; W192A; Y273M; G284A; | 2.40 |
| 483/484 | P48S; I124W; S126A; W136L; W192A; G284A; | 1.32 |
| 485/486 | I124W; S126A; W136L; W192A; G284A; G295N; | 1.56 |
| 487/488 | P8H; I124W; S126A; W136L; W192A; G284A; S297G; | 3.75 |
| 489/490 | I124W; S126A; W136L; W192A; G284A; D300L; | 1.66 |
| 491/492 | I124W; S126A; W136L; W192A; G284A; S297D; | 1.83 |
| 493/494 | I124W; S126A; W136L; W192A; G284A; S323E; | 2.28 |
| 495/496 | I124W; S126A; W136L; W192A; G284A; L325M; | 1.85 |
| 497/498 | I124W; S126A; W136L; W192A; G284A; R312M; | 1.65 |
| 499/500 | I124W; S126A; W136L; W192A; G284A; V319R; | 1.94 |
| 501/502 | I124W; S126A; W136L; W192A; G284A; S323C; | 1.75 |
| 503/504 | I124W; S126A; W136L; W192A; G284A; E316L; | 1.36 |
| 505/506 | I124W; S126A; W136L; W192A; G284A; E320Q; | 1.73 |
| 507/508 | I124W; S126A; W136L; W192A; G284A; E316R; | 1.76 |
| 509/510 | I124W; S126A; W136L; W192A; G284A; Q308A; | 1.98 |
| 511/512 | I124W; S126A; W136L; W192A; G284A; S309W; | 1.72 |
| 513/514 | I124W; S126A; W136L; W192A; G284A; S309L; | 3.76 |
| 515/516 | I124W; S126A; W136L; W192A; G284A; Q329P; | 2.12 |
| 517/518 | I124W; S126A; W136L; W192A; G284A; V319T; | 1.34 |
| 519/520 | I124W; S126A; W136L; W192A; G284A; V319Y; | 2.50 |
| 521/522 | I124W; S126A; W136L; W192A; G284A; P305Q; | 1.83 |
| 523/524 | I124W; S126A; W136L; W192A; G284A; S323R; | 2.43 |
| 525/526 | A5K; D6S; I124F; S126A; W136L; W192A; C215F; G284A; | 51.4 |
| 527/528 | A5L; D6S; I124F; S126A; W136L; W192A; C215F; G284A; | 52.5 |

[1] HTP activity assay:
Cells were lysed by shaking for 1 h at 250 rpm and room temperature in 150 μL of lysis buffer containing 0.2 M borate, 0.5 g/L lysozyme, and 0.4 g/L polymyxin B sulfate at pH 10.5. Enzymatic reaction: 50 g/L of substrate compound 2, 40 μL clear cell lysate, 50% (v/v) DMSO, 1 M isopropylamine (IPM), 1 g/L PLP, 0.2 M borate, pH 10.5 at 62° C. for 24 h in a total reaction volume of 200 μL. Activity relative to the activity of the reference polypeptide of SEQ ID NO: 84 was calculated as the % conversion of the product formed per % conversion of the reference polypeptide under the same HTP activity assay conditions. % Conversion was quantified by dividing the areas of the product peak by the sum of the areas of the substrate and product peak as determined by HPLC analysis.

TABLE 2F

| SEQ ID NO: (nt/aa) | Amino Acid Differences (relative to SEQ ID NO: 4) | HTP Assay Activity[1] (relative to SEQ ID NO: 372) |
|---|---|---|
| 371/372 | I124W; S126A; W136L; W192A; C215F; G284A; | 1 |
| 529/530 | E50S; I124W; S126A; W136L; W192A; C215F; G284A; Q329P; | 1.66 |
| 531/532 | Q102W; I124W; S126A; W136L; W192A; C215F; V234L; G284A; N296R; Q329P; | 1.47 |
| 533/534 | I124W; S126A; W136L; W192A; C215F; G284A; S309L; | 1.56 |
| 535/536 | I124W; S126A; W136L; D161M; W192A; C215F; G284A; | 1.43 |
| 537/538 | I124W; S126A; W136L; W192A; C215F; A270R; Y273V; G284A; | 1.98 |
| 539/540 | I124W; S126A; W136L; W192A; C215F; G284A; S309L; V319T; | 1.52 |
| 541/542 | Q102T; I124W; S126A; W136L; Q146R; D161M; W192A; C215F; A270R; G284A; Q329P; | 1.63 |
| 543/544 | I124W; S126A; W136L; Q146R; W192A; C215F; G284A; Q329P; | 1.21 |
| 545/546 | I124W; S126A; W136L; W192A; C215F; D274L;G284A; V319T; Q329P; | 1.33 |
| 547/548 | I124W; S126A; W136L; Q146R; W192A; C215F; Y273V; G284A; | 1.43 |
| 549/550 | I124W; S126A; W136L; W192A; C215F; D274L; G284A; | 2.87 |
| 551/552 | Q102W; I124W; S126A; W136L; W192A; C215F; Y273V; G284A; Q329P; | 1.84 |
| 553/554 | I124W; S126A; W136L; W192A; C215F; Y273V; D274L; G284A; | 1.75 |
| 555/556 | I124W; S126A; W136L; D161M; W192A; C215F; G284A; Q329P; | 1.52 |

TABLE 2F-continued

| SEQ ID NO: (nt/aa) | Amino Acid Differences (relative to SEQ ID NO: 4) | HTP Assay Activity[1] (relative to SEQ ID NO: 372) |
|---|---|---|
| 557/558 | Q102T; I124W; S126A; W136L; W192A; C215F; A270R; Y273V; D274L; G284A; V319T; | 1.33 1.84 |
| 559/560 | Q102T; I124W; S126A; W136L; W192A; C215F; Y273V; D274L; G284A; | |
| 561/562 | I124W; S126A; W136L; W192A; C215F; G284A; N296R; | 1.96 |
| 563/564 | Q102W; I124W; S126A; W136L; W192A; C215F; V234L; G284A; Q329P; | 1.23 |
| 565/566 | I124W; S126A; W136L; W192A; C215F; G284A; S309L; V319T; Q329P; | 1.51 |
| 567/568 | I124W; S126A; W136L; D161M; W192A; C215F; V234L; G284A; V319T; | 1.37 |
| 569/570 | I124W; S126A; W136L; W192A; C215F; A270R; G284A; Q329P; | 1.74 |
| 571/572 | I124W; S126A; W136L; D161M; W192A; C215F; A265W; G284A; N296R; Q329P; | 1.75 |
| 573/574 | I124W; S126A; W136L; W192A; C215F; G284A; E316L; | 1.86 |
| 575/576 | P48S; I124W; S126A; W136L; W192A; C215F; G284A; N296W; S323C; | 2.03 |
| 577/578 | G17L; P48S; F88W; E120F; I124W; S126A; W136L; W192A; C215F; Y273M; G284A; | 1.74 |
| 579/580 | G17L; P48S; F88W; D103N; I124W; S126A; W136L; W192A; C215F; Y273M; D274T; G284A; | 3.80 |
| 581/582 | I124W; S126A; W136L; W192A; C215F; Y273R; G284A; S323C; | 4.53 |
| 583/584 | I124W; S126A; W136L; W192A; C215F; Y273M; D274T; G284A; S323C; | 1.77 |
| 585/586 | G17L; P48S; F88W; I124W; S126A; W136L; W156S; W192A; C215F; Y273R; D274T; G284A; N296S; S323C; | 2.09 |
| 587/588 | G17L; F88W; I124W; S126A; W136L; W192A; C215F; G284A; | 2.06 |
| 589/590 | G17L; P48S; I124W; S126A; W136L; W192A; C215F; G284A; N296W; S323C; | 1.64 |
| 591/592 | G17L; E120F; I124W; S126A; W136L; W192A; C215F; G284A; | 1.31 |
| 593/594 | F88W; I124W; S126A; W136L; W156S; W192A; C215F; Y273M; D274T; G284A; S323C; | 1.56 |
| 595/596 | G17L; E120F; I124W; S126A; W136L; W192A; C215F; Y273M; G284A; S323C; | 1.68 |
| 597/598 | I124W; S126A; W136L; W192A; C215F; Y273R; G284A; | 1.51 |
| 599/600 | G17L; I124W; S126A; W136L; W192A; C215F; D274T; G284A; S323C; | 1.43 |
| 601/602 | I124W; S126A; W136L; W192A; C215F; D274T; G284A; | 1.35 |
| 603/604 | P48S; F88W; I124W; S126A; W136L; W192A; C215F; G284A; | 1.70 |
| 605/606 | P48S; F88W; Y273M; | 2.00 |
| 607/608 | I124W; S126A; W136L; W192A; C215F; G284A; S323C; | 1.43 |
| 609/610 | P48S; I124W; S126A; W136L; W192A; C215F; G284A; S323C; | 2.09 |
| 611/612 | P48S; I124W; S126A; W136L; W156S; W192A; C215F; Y273M; D274T; G284A; E316L; | 1.29 |
| 613/614 | G17L; P48S; F88W; I124W; S126A; W136L; W192A; C215F; G284A; E316L; | 2.36 |
| 615/616 | G17L; F88W; Y273M; I124W; S126A; W136L; W192A; C215F; G284A; | 2.25 |
| 617/618 | G17L; P48S; I124W; S126A; W136L; W192A; C215F; G284A; | 1.33 |
| 619/620 | G17L; P48S; Y273R; I124W; S126A; W136L; W192A; C215F; G284A; S323C; | 1.87 |
| 621/622 | G17L; F88W; E120F; W156S; I124W; S126A; W136L; W192A; C215F; Y273M; D274T; G284A; | 1.46 |
| 623/624 | G17L; P48S; F88W; E120F; W156S; I124W; S126A; W136L; W192A; C215F; Y273M; D274T; G284A; S323C; | 3.98 |
| 625/626 | G17L; I124W; S126A; W136L; W192A; C215F; G284A; N296W; S297G; S323C; | 1.41 |
| 627/628 | G17L; I124W; S126A; W136L; W192A; C215F; G284A; | 2.06 |
| 629/630 | P48S; F88W; I124W; S126A; W136L; W192A; C215F; G284A; S323C; | 2.74 |

[1]HTP activity assay:
Cells were lysed by shaking for 1 h at 250 rpm and room temperature in 150 μL of lysis buffer containing 0.2 M borate, 0.5 g/L lysozyme, and 0.4 g/L polymyxin B sulfate at pH 10.5. Enzymatic reaction: 50 g/L of substrate compound 2, 40 μL clear cell lysate, 50% (v/v) DMSO, 1 M isopropylamine (IPM), 1 g/L PLP, 0.2 M borate, pH 10.5 at 65° C. for 24 h in a total reaction volume of 200 μL. Activity relative to the activity of the reference polypeptide of SEQ ID NO: 372 was calculated as the % conversion of the product formed per % conversion of the reference polypeptide under the same HTP activity assay conditions. % Conversion was quantified by dividing the areas of the product peak by the sum of the areas of the substrate and product peak as determined by HPLC analysis.

TABLE 2G

| SEQ ID NO: (nt/aa) | Amino Acid Differences (relative to SEQ ID NO: 4) | HTP Assay Activity[1] (relative to SEQ ID NO: 582) |
|---|---|---|
| 581/582 | I124W; S126A; W136L; W192A; C215F; Y273R; G284A; S323C; | 1 |
| 631/632 | P48S; F88W; I124W; S126A; W136L; W192A; C215F; Y273R; D274L; G284A; N296R; S323C; | 2.16 |
| 633/634 | P48S; F88W; D103N; I124W; S126A; W136L; W192A; C215F; Y273R; G284A; S323C; | 2.15 |
| 635/636 | P48S; F88W; I124W; S126A; W136L; W192A; C215F; Y273R; G284A; N296R; S323C; | 2.16 |
| 637/638 | P48S; F88W; I124W; S126A; W136L; W192A; C215F; Y273R; G284A; S323C; | 2.12 |
| 639/640 | P48S; F88W; D103N; I124W; S126A; W136L; W192A; C215F; Y273R; G284A; N296S; S323C; | 3.34 |
| 641/642 | P48S; F88W; I124W; S126A; W136L; W192A; C215F; Y273R; G284A; N296S; S323C; | 2.62 |
| 643/644 | P48S; F88W; Q102T; D103N; I124W; S126A; W136L; W192A; C215F; Y273R; G284A; S323C; | 2.41 |
| 645/646 | P48S; F88W; Q102T; I124W; S126A; W136L; W192A; C215F; Y273R; G284A; N296S; S323C; | 2.82 |
| 647/648 | I21L; I124W; S126A; W136L; W192A; C215F; Y273R; G284A; S323C; | 2.40 |
| 649/650 | P48G; I124W; S126A; W136L; W192A; C215F; G284A; S323C; | 1.81 |
| 651/652 | P48R; I124W; S126A; W136L; W192A; C215F; G284A; S323C; | 2.06 |
| 653/654 | T66A; I124W; S126A; W136L; W192A; C215F; G284A; S323C; | 6.23 |
| 655/656 | F56W; I124W; S126A; W136L; W192A; C215F; G284A; S323C; | 3.40 |
| 657/658 | T62C; I124W; S126A; W136L; W192A; C215F; G284A; S323C; | 2.78 |
| 659/660 | T66S; I124W; S126A; W136L; W192A; C215F; G284A; S323C; | 2.48 |
| 661/662 | P48W; I124W; S126A; W136L; W192A; C215F; G284A; S323C; | 2.42 |
| 663/664 | I124F; S126A; W136L; W192A; C215F; G284A; S323C; | 2.52 |
| 665/666 | I124W; S126A; W136L; W192A; C215F; G284A; S323C; L325Q; | 1.75 |
| 667/668 | I124W; S126G; W136L; W192A; C215F; G284A; S323C; | 3.56 |
| 669/670 | I124W; S126A; T134V; W136L; W192A; C215F; G284A; S323C; | 2.03 |
| 671/672 | I124W; S126A; T134G; W136L; W192A; C215F; G284A; S323C; | 2.28 |
| 673/674 | I124W; S126A; T134Y; W136L; W192A; C215F; G284A; S323C; | 2.26 |
| 675/676 | I124W; S126A; W136Y; W192A; C215F; G284A; S323C; | 2.10 |
| 677/678 | I124W; S126A; T134L; W136L; W192A; C215F; Y273R; G284A; S323C; | 2.01 |
| 679/680 | I124W; S126A; W136L; K142M; W192A; C215F; Y273R; G284A; S323C; | 1.95 |
| 681/682 | I124W; S126A; W136L; Q155L; W192A; C215F; Y273R; G284A; S323C; | 2.53 |
| 683/684 | I124W; S126A; W136L; P185A; W192A; C215F; Y273R; G284A; S323C; | 1.98 |
| 685/686 | I124W; S126A; W136L; Q155I; W192A; C215F; Y273R; G284A; S323C; | 2.96 |
| 687/688 | I124W; S126A; W136L; W192A; P210A; C215F; Y273R; G284A; S323C; | 3.87 |
| 689/690 | I124W; S126A; W136L; Q191S; W192A; C215F; Y273R; G284A; S323C; | 4.56 |
| 691/692 | I124W; S126A; W136L; Q191G; W192A; C215F; Y273R; G284A; S323C; | 5.31 |
| 693/694 | I124W; S126A; W136L; W192A; P210G; C215F; Y273R; G284A; S323C; | 3.28 |
| 695/696 | I124W; S126A; W136L; Q191A; W192A; C215F; Y273R; G284A; S323C; | 3.44 |
| 697/698 | I124W; S126A; W136L; W192S; C215F; Y273R; G284A; S323C; | 2.25 |
| 699/700 | I124W; S126A; W136L; W192A; P210S; C215F; Y273R; G284A; S323C; | 3.41 |
| 701/702 | S49P; I124W; S126A; W136L; W192A; C215F; P223S; Y273R; G284A; S323C; | 3.38 |
| 703/704 | I124W; S126A; W136L; W192A; C215F; P223A; Y273R; G284A; S323C; | 2.64 |
| 705/706 | I124W; S126A; W136L; W192A; C215F; Y273R; S282T; G284A; S323C; | 2.22 |
| 707/708 | I124W; S126A; Y131F; W136L; Q155L; W156F; W192A; C215F; Y273R; G284A; S323C; | 1.78 |
| 709/710 | I124W; S126A; W136L; Q155C; W156F; W192A; C215F; Y273R; G284A; S323C; | 2.12 |

[1]HTP activity assay:
Cells were lysed by shaking for 1 h at 250 rpm and room temperature in 150 μL of lysis buffer containing 0.2 M borate, 0.5 g/L lysozyme, and 0.4 g/L polymyxin B sulfate at pH 10.5. Enzymatic reaction: 50 g/L of substrate compound 2, 40 μL clear cell lysate, 50% (v/v) DMSO, 1 M isopropylamine (IPM), 1 g/L PLP, 0.2 M borate, pH 10.5 at 55° C. for 24 h in a total reaction volume of 200 μL. Activity relative to the activity of the reference polypeptide of SEQ ID NO: 582 was calculated as the % conversion of the product formed per % conversion of the reference polypeptide under the same HTP activity assay conditions. % Conversion was quantified by dividing the areas of the product peak by the sum of the areas of the substrate and product peak as determined by HPLC analysis.

TABLE 2H

| SEQ ID NO: (nt/aa) | Amino Acid Differences (relative to SEQ ID NO: 4) | HTP Assay Activity[1] (relative to SEQ ID NO: 696) |
|---|---|---|
| 695/696 | None | 1 |
| 711/712 | I124W; S126A; W136L; Q191A; W192A; C215F; P223S; Y273R; S282T; G284A; S323C; | 2.14 |
| 713/714 | F56W; I124W; S126A; W136L; Q191S; W192A; P210G; C215F; P223A; Y273R; S282T; G284A; S323C; | 2.43 |
| 715/716 | I124W; S126G; W136L; Q191A; W192A; C215F; Y273R; G284A; S323C; | 2.48 |
| 717/718 | I21L; F56W; I124W; S126G; W136L; Q191A; W192A; C215F; Y273R; S282T; G284A; S323C; | 1.71 |
| 719/720 | I124W; S126A; W136L; Q191A; W192A; P210G; C215F; Y273R; G284A; S323C; | 1.93 |
| 721/722 | I21L; I124W; S126A; W136L; Q191A; W192A; P210G; C215F; Y273R; G284A; S323C; | 1.97 |
| 723/724 | I21L; I124W; S126G; W136L; Q191A; W192A; C215F; P223A; Y273R; G284A; S323C; | 1.84 |
| 725/726 | I21L; F56W; I124W; S126A; W136L; Q191A; W192A; P210G; C215F; Y273R; G284A; S323C; | 1.95 |
| 727/728 | P48S; F88W; I124W; S126A; W136L; Q191A; W192A; C215F; Y273R; G284A; N296S; S323C; | 2.12 |
| 729/730 | P48S; I124W; S126A; T134L; W136L; Q191A; W192A; C215F; Y273R; G284A; S323C; | 2.10 |
| 731/732 | P48S; F88W; D103N; I124W; S126A; W136L; Q191A; W192A; P210A; C215F; Y273R; G284A; S323C; | 2.25 |
| 733/734 | F88W; D103N; I124W; S126A; W136L; Q191A; W192A; C215F; Y273R; G284A; S323C; | 1.34 |
| 735/73 6 | P48S; D103N; I124W; S126A; T134L; W136L; Q191A; W192A; C215F; Y273R; G284A; S323C; | 1.43 |
| 737/738 | P48S; F88W; D103N; I124W; S126A; T134L; W136L; Q191A; W192A; C215F; Y273R; G284A; N296S; S323C; | 1.39 |
| 739/740 | P48S; I124W; S126A; W136L; Q191A; W192A; P210A; C215F; Y273R; G284A; S323C; | 1.69 |
| 741/742 | P48A; F88W; I124W; S126A; W136L; Q191A; W192A; P210A; C215F; Y273R; G284A; N296S; S323C; | 3.52 |
| 743/744 | P48S; F88W; D103N; I124W; S126A; T134L; W136L; Q191A; W192A; C215F; Y273R; G284A; S323C; | 1.35 |
| 745/746 | P48S; I124W; S126A; W136L; Q191A; W192A; C215F; Y273R; G284A; S323C; | 1.36 |
| 747/748 | P48S; F88W; I124W; S126A; T134Y; W136L; Q191A; W192A; C215F; Y273R; G284A; N296S; S323C; | 1.41 |
| 749/750 | P48W; D103N; I124W; S126A; W136L; Q191A; W192A; C215F; Y273R; G284A; S323C; | 1.62 |
| 751/752 | P48S; D103N; I124W; S126A; W136L; Q191A; W192A; C215F; Y273R; G284A; N296S; S323C; | 1.48 |
| 753/754 | P48S; F88W; I124W; S126A; T134L; W136L; Q191A; W192A; C215F; Y273R; G284A; N296S; S323C; | 1.31 |
| 755/756 | P48W; F88W; I124W; S126A; T134L; W136L; Q191A; W192A; C215F; Y273R; G284A; N296S; S323C; | 1.30 |
| 757/758 | P48S; F88W; I124W; S126A; T134L; W136L; Q191A; W192A; C215F; Y273R; G284A; N296R; S323C; | 1.38 |
| 759/760 | P48W; F88W; D103N; I124W; S126A; W136L; Q191A; W192A; C215F; Y273R; G284A; S323C; | 1.27 |
| 761/762 | I21L; I124W; S126A; W136L; Q191A; W192A; C215F; Y273R; G284A; S323C; | 1.53 |
| 763/764 | I124W; S126A; W136L; Q191S; W192N; C215F; Y273R; G284A; S323C; | 1.46 |
| 765/766 | I124W; S126A; W136L; Q191A; W192S; C215F; Y273R; G284A; S323C; | 1.66 |
| 767/768 | I124W; S126A; S132H; W136L; Q191A; W192A; C215F; Y273R; G284A; S323C; | 2.49 |
| 769/770 | I55M; I124W; S126A; W136L; Q191A; W192A; C215F; Y273R; G284A; S323C; | 1.32 |
| 771/772 | S54L; I124W; S126A; W136L; Q191A; W192A; C215F; Y273R; G284A; S323C; | 1.36 |
| 773/774 | G37S; I124W; S126A; W136L; Q191A; W192A; C215F; Y273R; G284A; S323C; | 1.73 |
| 775/776 | G81K; I124W; S126A; W136L; Q191A; W192A; C215F; Y273R; G284A; S323C; | 1.50 |
| 777/778 | V46R; I124W; S126A; W136L; Q191A; W192A; C215F; Y273R; G284A; S323C; | 1.45 |
| 779/780 | T101L; I124W; S126A; W136L; Q191A; W192A; C215F; Y273R; G284A; S323C; | 1.56 |
| 781/782 | Q102R; I263V; I124W; S126A; W136L; Q191A; W192A; C215F; Y273R; G284A; S323C; | 1.94 |
| 783/784 | T101R; I124W; S126A; W136L; Q191A; W192A; C215F; Y273R; G284A; S323C; | 1.70 |

TABLE 2H-continued

| SEQ ID NO: (nt/aa) | Amino Acid Differences (relative to SEQ ID NO: 4) | HTP Assay Activity[1] (relative to SEQ ID NO: 696) |
|---|---|---|
| 785/786 | K106V; I124W; S126A; W136L; Q191A; W192A; C215F; Y273R; G284A; S323C; | 1.64 |
| 787/788 | K106T; A191G; I124W; S126A; W136L; Q191A; W192A; C215F; Y273R; G284A; S323C; | 1.77 |
| 789/790 | E107V; I124W; S126A; W136L; Q191A; W192A; C215F; Y273R; G284A; S323C; | 1.59 |
| 791/792 | I97T; I124W; S126A; W136L; Q191A; W192A; C215F; Y273R; G284A; S323C; | 1.93 |
| 793/794 | P99L; I124W; S126A; W136L; Q191A; W192A; C215F; Y273R; G284A; S323C; | 1.48 |
| 795/796 | K106S; I124W; S126A; W136L; Q191A; W192A; C215F; Y273R; G284A; S323C; | 1.36 |
| 797/798 | D103V; I124W; S126A; W136L; Q191A; W192A; C215F; Y273R; G284A; S323C; | 1.83 |
| 799/800 | I108T; I124W; S126A; W136L; Q191A; W192A; C215F; Y273R; G284A; S323C; | 1.33 |
| 801/802 | K106L; I124W; S126A; W136L; Q191A; W192A; C215F; Y273R; G284A; S323C; | 1.32 |
| 803/804 | Q102H; I124W; S126A; W136L; Q191A; W192A; C215F; Y273R; G284A; S323C; | 1.55 |
| 805/806 | E85R; I124W; S126A; W136L; Q191A; W192A; C215F; Y273R; G284A; S323C; | 1.37 |
| 807/808 | S89L; I124W; S126A; W136L; Q191A; W192A; C215F; Y273R; G284A; S323C; | 1.32 |
| 809/810 | T101G; I124W; S126A; W136L; Q191A; W192A; C215F; Y273R; G284A; S323C; | 1.47 |
| 811/812 | I124W; S126A; W136L; T141L; Q191A; W192A; C215F; Y273R; G284A; S323C; | 1.78 |
| 813/814 | I124W; S126A; W136L; D165V; Q191A; W192A; C215F; Y273R; G284A; S323C; | 1.84 |
| 815/816 | I124W; S126A; W136L; D161N; Q191A; W192A; C215F; Y273R; G284A; S323C; | 1.79 |
| 817/818 | I124W; S126A; W136L; Q191A; W192A; H203M; C215F; Y273R; G284A; S323C; | 2.25 |
| 819/820 | I124W; S126A; W136L; R1441; Q191A; W192A; C215F; Y273R; G284A; S323C; | 1.73 |
| 821/822 | I124W; S126A; W136L; T141A; Q191A; W192A; C215F; Y273R; G284A; S323C; | 1.86 |
| 823/824 | I124W; S126A; W136L; 1140V; Q191A; W192A; C215F; Y273R; G284A; S323C; | 2.66 |
| 825/826 | I124W; S126A; W136L; H168E; Q191A; W192A; C215F; Y273R; G284A; S323C; | 2.21 |
| 827/828 | I124W; S126A; W136L; D165L; Q191A; W192A; C215F; Y273R; G284A; S323C; | 1.33 |
| 829/830 | I124W; S126A; W136L; R144D; Q191A; W192A; C215F; Y273R; G284A; S323C; | 1.33 |
| 831/832 | I124W; S126A; W136L; Q191A; W192A; C215F; N217L; H260Q; Y273R; G284A; S323C; | 1.30 |
| 833/834 | I124W; S126A; W136L; Q191A; W192A; C215F; E256R; Y273R; G284A; S323C; | 1.60 |
| 835/836 | I124W; S126A; W136L; Q191A; W192A; C215F; A270T; Y273R; G284A; S323C; | 1.46 |
| 837/838 | T66A; I124W; S126A; W136L; Q191A; W192A; C215F; Y273R; G284A; N296L; S323C; | 1.86 |
| 839/840 | I124W; S126A; W136L; Q191A; W192A; C215F; I263V; Y273R; G284A; S323C; | 1.34 |
| 841/842 | I124W; S126A; W136L; Q191A; W192A; C215F; Y273R; G284A; I311Q; S323C; | 1.97 |
| 843/844 | I124W; S126A; W136L; Q191A; W192A; C215F; Y273R; G284A; V319Y; S323C; | 1.72 |
| 845/846 | I124W; S126A; W136L; Q191A; W192A; C215F; Y273R; G284A; S323C; P327R; | 1.36 |
| 847/848 | I124W; S126A; W136L; Q191A; W192A; C215F; Y273R; G284A; S309T; S323C; | 1.42 |
| 849/850 | I124W; S126A; W136L; Q191A; W192A; C215F; Y273R; G284A; P305T; S323C; | 1.42 |
| 851/852 | I124W; S126A; W136L; Q191A; W192A; C215F; Y273R; G284A; S323N; | 1.47 |

TABLE 2H-continued

| SEQ ID NO: (nt/aa) | Amino Acid Differences (relative to SEQ ID NO: 4) | HTP Assay Activity[1] (relative to SEQ ID NO: 696) |
|---|---|---|
| 853/854 | I124W; S126A; W136M; Q191A; W192A; C215F; Y273R; G284A; S323C; | 1.69 |

[1]HTP activity assay:
Cells were lysed by shaking for 1 h at 250 rpm and room temperature in 150 μL of lysis buffer containing 0.2 M borate, 0.5 g/L lysozyme, and 0.4 g/L polymyxin B sulfate at pH 10.5. Enzymatic reaction: 50 g/L of substrate compound 2, 40 μL clear cell lysate, 50% (v/v) DMSO, 1 M isopropylamine (IPM), 1 g/L PLP, 0.2 M borate, pH 10.5 at 55° C. for 24 h in a total reaction volume of 200 μL. Activity relative to the activity of the reference polypeptide of SEQ ID NO: 696 was calculated as the % conversion of the product formed per % conversion of the reference polypeptide under the same HTP activity assay conditions. % Conversion was quantified by dividing the areas of the product peak by the sum of the areas of the substrate and product peak as determined by HPLC analysis.

TABLE 2I

| SEQ ID NO: (nt/aa) | Amino Acid Differences (relative to SEQ ID NO: 4) | % Conversion | Relative Activity[1] | d.r. | Reaction Condition[1] |
|---|---|---|---|---|---|
| 83/84 | I124W; S126A; W136L; W192A; G284A; | 34 | 1 | 61 | A |
| 371/372 | I124W; S126A; W136L; W192A; C215F; G284A; | 49 | 1.4 | 82 | A |
| 411/412 | L28N; I124W; S126A; W136L; W192A; G284A; | 39 | 1.1 | 73 | A |
| 525/526 | A5K; D6S; I124F; S126A; W136L; W192A; C215F; G284A; | 55 | 1.6 | 35 | A |
| 527/528 | A5L; D6S; I124F; S126A; W136L; W192A; C215F; G284A; | 51 | 1.5 | 36 | A |
| 83/84 | I124W; S126A; W136L; W192A; G284A; | 56.6 | 1 | 83 | B |
| 371/372 | I124W; S126A; W136L; W192A; C215F; G284A; | 78.3 | 1.4 | 371 | B |
| 549/550 | I124W; S126A; W136L; W192A; C215F; D274L; G284A; | 74.9 | 1.3 | 549 | B |
| 579/580 | G17L; P48S; F88W; D103N; I124W; S126A; W136L; W192A; C215F; Y273M; D274T; G284A; | 79.0 | 1.4 | 579 | B |
| 581/582 | I124W; S126A; W136L; W192A; C215F; Y273R; G284A; S323C; | 86.9 | 1.5 | 581 | B |
| 623/624 | G17L; P48S; F88W; E120F; W156S; I124W; S126A; W136L; W192A; C215F; Y273M; D274T; G284A; S323C; | 74.8 | 1.3 | 623 | B |
| 629/630 | P48S; F88W; I124W; S126A; W136L; W192A; C215F; G284A; S323C; | 78.9 | 1.4 | 629 | B |
| 581/582 | I124W; S126A; W136L; W192A; C215F; Y273R; G284A; S323C; | 32.0 | 1 | 128 | C |
| 639/640 | P48S; F88W; D103N; I124W; S126A; W136L; W192A; C215F; Y273R; G284A; N296S; S323C; | 39.9 | 1.2 | 113 | C |
| 647/648 | I21L; I124W; S126A; W136L; W192A; C215F; Y273R; G284A; S323C; | 37.3 | 1.2 | 137 | C |
| 653/654 | T66A; I124W; S126A; W136L; W192A; C215F; Y273R; G284A; S323C; | 22.2 | 0.7 | 105 | C |
| 655/656 | F56W; I124W; S126A; W136L; W192A; C215F; Y273R; G284A; S323C; | 22.8 | 0.7 | 99 | C |
| 667/668 | I124W; S126G; W136L; W192A; C215F; Y273R; G284A; S323C; | 32.7 | 1.0 | 107 | C |
| 691/692 | I124W; S126A; W136L; Q191G; W192A; C215F; Y273R; G284A; S323C; | 24.2 | 0.8 | 68 | C |
| 695/696 | I124W; S126A; W136L; Q191A; W192A; C215F; Y273R; G284A; S323C; | 39.5 | 1.2 | 61 | C |
| 699/700 | I124W; S126A; W136L; W192A; P210S; C215F; Y273R; G284A; S323C; | 44.2 | 1.4 | 104 | C |
| 703/704 | I124W; S126A; W136L; W192A; C215F; P223A; Y273R; G284A; S323C; | 46.8 | 1.5 | 67 | C |
| 581/582 | I124W; S126A; W136L; W192A; C215F; Y273R; G284A; S323C; | 33.6 | 1 | 128 | D |
| 653/654 | T66A; I124W; S126A; W136L; W192A; C215F; Y273R; G284A; S323C; | 46.7 | 1.4 | 105 | D |
| 667/668 | I124W; S126G; W136L; W192A; C215F; Y273R; G284A; S323C; | 41 | 1.2 | 139 | D |
| 695/696 | I124W; S126A; W136L; Q191A; W192A; C215F; Y273R; G284A; S323C; | 62.8 | 1.9 | 45 | D |
| 695/696 | I124W; S126A; W136L; Q191A; W192A; C215F; Y273R; G284A; S323C; | 30.9 | 1.0 | 63 | E |
| 763/764 | I124W; S126A; W136L; Q191S; W192N; C215F; Y273R; G284A; S323C; | 42.4 | 1.4 | 83 | E |

TABLE 2I-continued

| SEQ ID NO: (nt/aa) | Amino Acid Differences (relative to SEQ ID NO: 4) | % Conversion | Relative Activity[1] | d.r. | Reaction Condition[1] |
|---|---|---|---|---|---|
| 773/774 | G37S; I124W; S126A; W136L; Q191A; W192A; C215F; Y273R; G284A; S323C; | 37.7 | 1.2 | 68 | E |
| 797/798 | D103V; I124W; S126A; W136L; Q191A; W192A; C215F; Y273R; G284A; S323C; | 34.0 | 1.1 | 62 | E |
| 817/818 | I124W; S126A; W136L; Q191A; W192A; H203M; C215F; Y273R; G284A; S323C; | 35.1 | 1.1 | 64 | E |
| 823/824 | I140V; I124W; S126A; W136L; Q191A; W192A; C215F; Y273R; G284A; S323C; | 37.5 | 1.2 | 56 | E |
| 825/826 | I124W; S126A; W136L; H168E; Q191A; W192A; C215F; Y273R; G284A; S323C; | 39.1 | 1.3 | 57 | E |
| 695/696 | I124W; S126A; W136L; Q191A; W192A; C215F; Y273R; G284A; S323C; | 57.5 | 1.0 | 42 | F |
| 713/714 | F56W; I124W; S126A; W136L; Q191S; W192A; P210G; C215F; P223A; Y273R; S282T; G284A; S323C; | 53.1 | 0.9 | 14 | F |
| 715/715 | I124W; S126G; W136L; Q191A; W192A; C215F; Y273R; G284A; S323C; | 61.3 | 1.1 | 31 | F |
| 719/720 | I124W; S126A; W136L; Q191A; W192A; P210G; C215F; Y273R; G284A; S323C; | 64.7 | 1.1 | 28 | F |
| 741/742 | P48A; F88W; I124W; S126A; W136L; Q191A; W192A; P210A; C215F; Y273R; G284A; N296S; S323C; | 53.7 | 0.9 | 21 | F |
| 695/696 | I124W; S126A; W136L; Q191A; W192A; C215F; Y273R; G284A; S323C; | 50.8 | 1.0 | 60 | G |
| 797/798 | D103V; I124W; S126A; W136L; Q191A; W192A; C215F; Y273R; G284A; S323C; | 58.3 | 1.1 | 52 | G |
| 817/818 | I124W; S126A; W136L; Q191A; W192A; H203M; C215F; Y273R; G284A; S323C; | 43.8 | 0.9 | 69 | G |
| 823/824 | I124W; S126A; W136L; I140V; Q191A; W192A; C215F; Y273R; G284A; S323C; | 56.4 | 1.1 | 53 | G |

[1]Reaction conditions:

A: In a 5 mL vial: 50 g/L of substrate compound 2, 10% (w/w) SFP of transaminase polypeptide, 50% (v/v) DMSO, 1 M isopropylamine (IPM), 1 g/L PLP, 0.2 M borate, pH 10.5, 55° C. and 23 h. Relative Activity was determined relative to the activity of reference polypeptide of SEQ ID NO: 84 and was calculated as the % conversion of the product formed per % conversion of the reference polypeptide under the same HTP activity assay conditions.

B: In a 5 mL vial: 50 g/L of substrate compound 2, 10% (w/w) SFP of transaminase polypeptide, 50% (v/v) DMSO, 1 M isopropylamine (IPM), 1 g/L PLP, 0.2 M borate, pH 10.5, 60° C. and 46 h. Relative Activity was determined relative to the activity of reference polypeptide of SEQ ID NO: 84 and was calculated as the % conversion of the product formed per % conversion of the reference polypeptide under the same HTP activity assay conditions.

C: In a 5 mL vial: 50 g/L of substrate compound 2, 7.5% (w/w) SFP of transaminase polypeptide, 50% (v/v) DMSO, 1 M isopropylamine (IPM), 1 mM PLP, 0.2 M borate, pH 10.5, 55° C. and 19 h. Relative Activity was determined relative to the activity of reference polypeptide of SEQ ID NO: 582 and was calculated as the % conversion of the product formed per % conversion of the reference polypeptide under the same HTP activity assay conditions.

D: In a 5 mL vial: 50 g/L of substrate compound 2, 7.5% (w/w) DSP powder of transaminase polypeptide, 50% (v/v) DMSO, 1 M isopropylamine (IPM), 1 mM PLP, 0.2 M borate, pH 10.5, 55° C. "% Conversion" were based on amount of product formed at 18 h. Relative Activity was determined relative to the activity of reference polypeptide of SEQ ID NO: 582 and was calculated as the % conversion of the product formed at 46 h per % conversion of the reference polypeptide under the same HTP activity assay conditions.

E: In a 5 mL vial: 50 g/L of substrate compound 2, 10% (w/w) SFP of transaminase polypeptide, 50% (v/v) DMSO, 1 M isopropylamine (IPM), 1 mM PLP, 0.2 M borate, pH 10.5, 55° C. and 18 h. Relative Activity was determined relative to the activity of reference polypeptide of SEQ ID NO: 696 and was calculated as the % conversion of the product formed per % conversion of the reference polypeptide under the same HTP activity assay conditions.

F: In a 5 mL vial: 50 g/L of substrate compound 2, 7.5% (w/w) DSP powder of transaminase polypeptide, 50% (v/v) DMSO, 1 M isopropylamine (IPM), 1 mM PLP, 0.2 M borate, pH 10.5, 55° C. "% Conversion" were based on amount of product formed at 18 h. Relative Activity was determined relative to the activity of reference polypeptide of SEQ ID NO: 696 and was calculated as the % conversion of the product formed at 46 h per % conversion of the reference polypeptide under the same HTP activity assay conditions.

G: In a 5 mL vial: 50 g/L of substrate compound 2, 10% (w/w) DSP powder of transaminase polypeptide, 50% (v/v) DMSO, 1 M isopropylamine (IPM), 1 mM PLP, 0.2 M borate, pH 10.5, 55° C. "% Conversion" were based on amount of product formed at 18 h. Relative Activity was determined relative to the activity of reference polypeptide of SEQ ID NO: 696 and was calculated as the % conversion of the product formed at 46 h per % conversion of the reference polypeptide under the same HTP activity assay conditions.

The exemplary engineered polypeptides associated with their improved properties for conversion of compound 2 to compound 1 include one or more residue differences as compared to SEQ ID NO:4 at the following residue positions: X2; X4; X5; X6; X8; X9; X10; X12; X13; X17; X18; X21; X22; X25; X27; X28; X29; X30; X31; X34; X37; X42; X43; X46; X47; X48; X49; X50; X52; X54; X55; X56; X61; X62; X64; X66 X68; X69; X72; X80; X81; X84; X85; X88; X97; X99; X101; X102; X103; X106; X107; X108; X115; X117; X120; X122; X124; X126; X127; X128; X131; X132; X134; X136; X139; X140; X141; X142; X143; X144; X146; X150; X152; X155; X156; X157; X159; X160; X161; X165; X168; X176; X179; X185; X190; X191; X192; X196; X199; X208; X209; X210; X215; X217; X223; X227; X231; X233; X234; X241; X256; X260; X263; X265; X266; X267; X269; X270; X273; X274; X282; X284; X295; X296; X297; X300; X305; X308; X309; X311; X312; X316; X319; X320; X323; X324; X325; X327; and X329. The specific amino acid differences at each of these positions that are associated with the improved properties of the exemplary polypeptides of Tables 2A, 2B, 2C, 2D, 2E, 2F, 2G, 2H, and 2I include: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X10L; X12H; X13A, X13F; X17L; X18I; X21L; X22A, X22H; X25A; X27L, X27H, X27P; X28N; X29N, X29T; X30F, X30G; X31H, X31R; X34V; X42G; X43S; X47R; X48G, X48R, X48S, X48W; X49I, X49P; X50S; X52H; X54A, X54L, X54M, X54P, X54R; X56D, X56E, X56W; X61G; X61W; X62A, X62L, X62N, X62S; X64C; X66A, X66S; X68I; X69A, X69G, X69T; X72A; X80Q; X84T; X85L; X88W; X97P; X102T, X102W; X103G, X103N; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X134G, X134L, X134S, X134V, X134Y, X134W; X136F, X136K, X136L, X136M, X136Y; X139E; X140A, X140K; X140M, X140T; X142M; X143V; X146R; X150L; X150S; X152A, X152C, X152F, X152G, X152I, X152L, X152R, X152S, X152W; X155C, X155I, X155L, X155T; X156A, X156F, X156S, X156T; X157L; X159G; X160L; X161M; X165N; X168R; X176C; X179K; X185A; X190M; X191A, X191G, X191S; X192A, X192G, X192H, X192K, X192N, X192Q, X192R, X192S; X196L, X196V; X199L, X199V; X208K; X209F, X209M, X209Q, X209V; X210G, X210S; X215F, X215H, X215L; X223A, X223S, X223T, X223V; X227I; X231T; X233D; X234L; X241R; X265Y, X265W; X266N; X267V; X269L, X269T; X270R; X273D, X273H, X273M, X273R, X273V; X274F, X274L, X274R, X274T; X282I, X282L, X282T, X282V; X284A, X284P, X284S, X284T, X284V; X295N, X295S; X296D, X296R, X296S, X296W; X300G, X300L; X305Q; X308A; X309W, X309L; X311T; X312C, X312M; X316L, X316R; X319R, X319T, X319Y; X320G, X320Q; X323C, X323E, X323R; X324Q; X325M, X325P, X325Q, X325V; X327L; and X329P.

Based on the properties of the exemplary polypeptides, increases in enzyme activity (i.e., conversion of compound 2 to compound 1a and compound 1d) are associated with residue differences as compared to SEQ ID NO:4 at residue positions X21; X37; X54; X56; X61; X62; X64; X66; X68; X69; X103; X122; X124; X126; X136; X139; X140; X143; X150; X155; X156; X157; X159; X160; X168; X176; X191; X192; X199; X209; X210; X215; X223; X227; X273; X282; X284, and X323. Substrate binding function which affects, in part, enzyme activity and diastereomeric ratio (i.e., compound 1a+compound 1d over compound 1b+compound 1c) are associated with residue differences at residue positions X21; X37; X61; X62; X69; X122; X124; X126; X136; X150; X191; X192; X199; X203; X209; X215; X223; X273, X282; X284, and X323. Increases in diastereomeric ratio of compound 1a and compound 1d over compounds 1b and compound 1c are associated with residue differences at residue positions X21, X62, X124, X136, X152, X192, X215, and X284. Some decrease in diastereomeric ratio of compound 1a and compound 1d over compound 1b and compound 1c are associated with residue position X69. Increases in enzyme stability, particularly in presence of solvent DMSO, are associated with, among others, residue differences at residue positions X152, X192, X215, X273, and X323. Increases in thermal stability are associated with, among others, residue differences at residue positions X215, X273, and X323, in particular the residue differences X215F, X273R, and X323C. As will be apparent to the skilled artisan, the foregoing residue positions and the specific amino acid residues for each residue position can be used individually or in various combinations to synthesize transaminase polypeptides having desired improved properties, including, among others, enzyme activity, stereoselectivity, and stability.

In light of the guidance provided herein, it is further contemplated that any of the exemplary engineered polypeptides having the even-numbered sequence identifiers of SEQ ID NO: 6-854 can be used as the starting amino acid sequence for synthesizing other engineered transaminase polypeptides, for example by subsequent rounds of evolution by adding in new combinations of various amino acid differences from other polypeptides in Tables 2A, 2B, 2C, 2D, 2E, 2F, 2G, 2H, and 2I and other residue positions described herein. Further improvements may be generated by including amino acid differences at positions that had been maintained as unchanged throughout earlier rounds of evolution.

Accordingly, in some embodiments, the transaminase polypeptide capable of carrying out the conversion of compound 2 to compound 1 comprises an amino acid sequence having at least 80%, 85%, 86%, 87%, 88%, 89%, 90%, 91%, 92%, 93%, 94%, 95%, 96%, 97%, 98%, 99% or more identity to reference sequence SEQ ID NO:2 and (a) one or more residue differences as compared to SEQ ID NO:2 at residue positions selected from: X6, X10, X12, X13, X17, X21, X29, X31, X34, X43, X46, X47, X64, X66, X68, X72, X80, X84, X85, X88, X97, X99, X101, X103, X106, X107, X115, X127, X128, X131, X134, X139, X140, X143, X144, X159, X161, X168, X176, X179, X185, X190, X191, X192, X196, X208, X227, X231, X233, X234, X241, X256, X260, X263, X266, X270, X274, X295, X300, X305, X308, X309, X311, X312, X316, X319, X320, X323, X324, X325, and X327, or (b) one or more residue differences as compared to SEQ ID NO:4 selected from: X2M; X4F, X4L; X5C, X5F, X5M, X5P, X5Y; X6F, X6R, X6S, X6T; X8H; X9I, X9F, X9L; X10L; X12H; X13A, X13F; X17L; X18I; X21L; X22A, X22H; X25A; X27L, X27H, X27P; X28N; X29N, X29T; X30F, X30G; X31H, X31R; X34V; X37S; X42G; X43S; X46R; X47R; X48R, X48S, X48W; X49I, X49P; X50S; X52H; X54A, X54L, X54M, X54P, X54R; X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P, X97T; X99L; X101G, X101L, X101R; X102H, X102R; X102T, X102W; X103G, X103N, X103V; X106L, X106S, X106T, X106V; X107V; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X136F, X136K, X136L, X136M, X136Y; X139E; X140A, X140K; X140M, X140T, X140V; X141A; X142M; X143V; X144D, X144I; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X192A, X192G, X192H, X192K, X192N, X192Q, X192R, X192S; X196L, X196V; X199L, X199V; X203M; X208K; X209F, X209M, X209Q, X209V; X210G; X215H, X215L; X217L; X223A, X223S, X223T, X223V; X227I; X231T; X233D; X234L; X241R; X256R; X260Q; X263V; X265Y, X265W; X266N; X267V; X269L, X269T; X270R; X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X300G, X300L; X305Q, X305T; X308A; X309L, X309T, X309W; X311Q, X311T; X312C, X312M; X316L, X316R; X319R, X319T, X319Y; X320G, X320Q; X323C, X323E, X323N, X323R; X324Q; X325M, X325P, X325Q, X325V; X327L, X327R; and X329P.

In some embodiments, the transaminase polypeptide capable of converting compound 2 to compound 1 comprises an amino acid sequence an amino acid sequence having at least 80%, 85%, 86%, 87%, 88%, 89%, 90%, 91%, 92%, 93%, 94%, 95%, 96%, 97%, 98%, 99% or more identity to a reference sequence selected from the even-numbered sequence identifiers of SEQ ID NO: 4-854, and (a) one or more residue differences as compared to SEQ ID NO:4 at residue positions selected from: X6, X10, X12, X13, X17, X21, X22, X29, X31, X34, X43, X47, X64, X66, X68, X72, X80, X84, X85, X88, X97, X103, X115, X127, X128, X131, X134, X139, X140, X142, X143, X159, X161, X168, X176, X179, X185, X190, X191, X192, X196, X208, X210, X227, X231, X233, X234, X241, X265, X266, X270, X274, X295, X300, X305, X308, X309, X311, X312, X316, X319, X320, X323, X324, X325, and X327, or (b) one or more residue differences as compared to SEQ ID NO:4 selected from: X2M; X4F; X4L; X5C; X5F; X5M; X5P; X5Y; X6F; X6R; X6S; X6T; X8H; X9I, X9F; X9L; X10L; X12H; X13A; X13F; X17L; X18I; X21L; X22A; X22H; X25A; X27L; X27H; X27P; X28N; X29N; X29T; X30F; X30G; X31H; X31R; X34V; X37S; X42G; X43S; X46R; X47R; X48R; X48S, X48W; X49I, X49P; X50S; X52H; X54A, X54L, X54M, X54P, X54R; X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P, X97T; X99L; X101G, X101L, X101R; X102H, X102R; X102T; X102W; X103G, X103N, X103V; X106L, X106S, X106T, X106V; X107V; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X136F, X136K, X136L, X136M, X136Y; X139E; X140A, X140K; X140M, X140T, X140V; X141A; X142M; X143V; X144D, X144I; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X192A, X192G, X192H, X192K, X192N, X192Q, X192R, X192S; X196L, X196V; X199L, X199V; X203M; X208K, X209F, X209M, X209Q, X209V; X210G; X215H, X215L; X217L; X223A, X223S, X223T, X223V; X227I; X231T; X233D; X234L; X241R; X256R; X260Q; X263V; X265Y; X265W; X266N; X267V; X269L, X269T; X270R, X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X300G, X300L; X305Q, X305T; X308A; X309L, X309T, X309W; X311Q, X311T; X312C, X312M; X316L, X316R; X319R, X319T, X319Y; X320G, X320Q; X323C, X323E, X323N, X323R; X324Q; X325M, X325P, X325Q, X325V; X327L, X327R; and X329P. In some embodiments, the reference sequence is selected from SEQ ID NO: 4, 6, 16, 34, 60, 84, 186, 298, 372, 582, 696, 764, 798, 818, or 824. In some embodiments, the reference sequence is SEQ ID NO:4. In some embodiments, the reference sequence is SEQ ID NO: 84. In some embodiments, the reference sequence is SEQ ID NO: 372. In some embodiments, the reference sequence is SEQ ID NO: 582. In some embodiments, the reference sequence is SEQ ID NO: 696. In some embodiments, the reference sequence is SEQ ID NO: 764. In some embodiments, the reference sequence is SEQ ID NO: 798. In some embodiments, the reference sequence is SEQ ID NO: 818. In some embodiments, the reference sequence is SEQ ID NO: 824.

In some embodiments, the transaminase polypeptide comprises an amino acid sequence having a combination of amino acid residue differences as compared to SEQ ID NO:4 that are present in SEQ ID NO: 84 (i.e., X124W, X126A, X136L, X192A and X284A), and further comprising amino acid differences at residue positions compared to SEQ ID NO:4 selected from the following: X2; X4; X5; X6; X8; X9; X10; X17; X18; X21; X22; X25; X27; X28; X29; X30; X31; X34; X37; X43; X46; X47; X48; X49; X50; X55; X66; X81; X85; X88; X97; X99; X101; X102; X106; X107; X108; X120; X131; X132; X141; X142; X144; X146; X161; X179; X185; X190; X191; X210; X217; X233; X234; X241; X256; X260; X263; X265; X270; X274; X297; X305; X308; X309; X316; X319; X323; and X329. In some embodiments, the further amino acid residue differences as compared to SEQ ID NO: 4 are selected from the following: X2M; X4F; X4L; X4Y; X5C; X5F; X5I; X5H; X5K; X5L; X5M; X5N; X5P; X5S; X5T; X5V; X5Y; X6F; X6S; X6T; X8H; X9L; X9I; X6R; X9Q; X9F; X10L; X17L; X18I; X21L; X22A; X22H; X25A; X27L; X27H; X27P; X28N; X29N; X29T; X30F; X30G; X31H; X31R; X34V; X37S; X43S; X46R; X47R; X48A, X48G, X48R, X48S, X48W; X49I, X49P; X50S; X54M; X55M; X56W; X66A, X66S; X81K; X85L, X85R; X88W; X89L; X97P, X97T; X99L; X101G, X101L, X101R; X102H, X102R; X102T; X102W; X103N, X103V; X106L, X106S, X106T, X106V; X107V; X108T; X120F; X126G; X131F; X132H; X134G, X134L, X134V, X134Y, X134W; X140A; X140M; X140T, X140V; X141A; X142M; X144D, X144I; X146R; X155C; X156F; X161M, X161N; X165L, X165V; X168E; X179K; X185A; X190M; X191A, X191G, X191S; X203M; X210G, X210S; X215F; X217L; X223A; X233D; X234L; X241R; X256R; X260Q; X263V; X265Y; X265W; X269T; X270R, X270T; X273D; X273M; X273R, X273V; X274F; X274L; X274R; X274T; X282T; X295N; X296L, X296R; X296S; X296W; X297D; X297G; X300L; X305Q, X305T; X308A; X309W; X309L, X309T; X311Q; X312M; X316L; X316R; X319R; X319T; X319Y; X320Q; X323C, X323E, X323N, X323R; X325M, X325Q; X327R; and X329P.

In some embodiments, the transaminase polypeptide above capable of converting compound 2 to compound 1 comprises an amino acid sequence having one or more residue differences as compared to SEQ ID NO:4 at residue positions selected from X6, X10, X12, X13, X17, X21, X29, X31, X34, X43, X46, X47, X64, X66, X68, X72, X80, X84, X85, X88, X97, X99, X101, X103, X106, X107, X115, X127, X128, X131, X134, X139, X140, X143, X144, X159, X161, X168, X176, X179, X185, X190, X191, X192, X196, X208, X227, X231, X233, X234, X241, X256, X260, X263, X266, X270, X274, X295, X300, X305, X308, X309, X311, X312, X316, X319, X320, X323, X324, X325, and X327. In some embodiments, the residue differences at residue positions X6, X10, X12, X13, X17, X21, X29, X31, X34, X43, X46, X47, X64, X66, X68, X72, X80, X84, X85, X88, X97, X99, X101, X103, X106, X107, X115, X127, X128, X131, X134, X139, X140, X143, X144, X159, X161, X168, X176, X179, X185, X190, X191, X192, X196, X208, X227, X231, X233, X234, X241, X256, X260, X263, X266, X270, X274, X295, X300, X305, X308, X309, X311, X312, X316, X319, X320, X323, X324, X325, and X327 are selected from the following: X6F, X6R, X6S, X6T; X10L; X12H; X13A, X13F; X17L; X21L; X29N, X29T; X31H, X31R; X34V; X43S; X46R; X47R; X64C; X66A, X66S; X68I; X72A; X80Q; X84T; X85L, X85R; X88W; X97P, X97T; X99L; X101G, X101L, X101R; X103G, X103N, X103V; X106L, X106S, X106T, X106V; X107V; X115R; X127T; X128A; X131F; X134G, X134L, X134S, X134V, X134Y, X134W; X139E; X140A, X140K; X140M, X140T, X140V; X143V; X144D, X144I; X159G; X161M, X161N; X168E, X168R; X176C; X179K; X185A; X190M; X191A, X191G, X191S; X192A, X192G, X192H, X192K, X192N, X192Q, X192R, X192S; X196L, X196V; X208K; X227I; X231T; X233D; X234L; X241R; X256R; X260Q; X263V; X266N; X270R, X270T; X274F, X274L, X274R, X274T; X295N, X295S; X300G, X300L; X305Q, X305T; X308A; X309L, X309T, X309W; X311Q, X311T; X312C, X312M; X316L, X316R; X319R, X319T, X319Y;

X320G, X320Q; X323C, X323E, X323N, X323R; X324Q; X325M, X325P, X325Q, X325V; X327L, X327R; and X329P.

In some embodiments, the transaminase polypeptide comprising an amino acid sequence having one or more residue differences at residue positions X6, X10, X12, X13, X17, X21, X29, X31, X34, X43, X46, X47, X64, X66, X68, X72, X80, X84, X85, X88, X97, X99, X101, X103, X106, X107, X115, X127, X128, X131, X134, X139, X140, X143, X144, X159, X161, X168, X176, X179, X185, X190, X191, X192, X196, X208, X227, X231, X233, X234, X241, X256, X260, X263, X266, X270, X274, X295, X300, X305, X308, X309, X311, X312, X316, X319, X320, X323, X324, X325, and X327 can further comprise one or more residue differences as compared to SEQ ID NO:4 at residue positions selected from: X2; X4; X5; X8; X9; X18; X22; X25; X27; X28; X30; X37; X42; X48; X49; X50; X52; X54; X55; X56; X61; X62; X69; X81; X102; X108; X117; X120; X122; X124; X126; X132; X136; X141; X142; X146; X150; X152; X155; X156; X157; X160; X165; X199; X209; X210; X215; X217; X223; X265; X267; X269; X273; X282; X284; X296; and X297. In some embodiments, the residue differences at residue positions X2; X4; X5; X8; X9; X18; X22; X25; X27; X28; X30; X37; X42; X48; X49; X50; X52; X54; X55; X56; X61; X62; X69; X81; X102; X108; X117; X120; X122; X124; X126; X132; X136; X141; X142; X146; X150; X152; X155; X156; X157; X160; X165; X199; X209; X210; X215; X217; X223; X265; X267; X269; X273; X282; X284; X296; and X297 are selected from the following: X2M; X4F, X4L, X4Y; X5C, X5F, X5I, X5H, X5K, X5L, X5M, X5N, X5P, X5S, X5T, X5V, X5Y; X8H; X9L, X9I, X9Q, X9F; X18I; X22A, X22H; X25A; X27L, X27H, X27P; X28N; X30F, X30G; X37S; X42G; X48A, X48G, X48R, X48S, X48W; X49I, X49P; X50S; X52H; X54A, X54L, X54M, X54P, X54R; X55M; X56D, X56E, X56W; X61G; X61W; X62A, X62L, X62N, X62S; X69A, X69G, X69T; X81K; X102H, X102R, X102T, X102W; X108T; X117V; X120F; X122F, X122M, X122W, X122Y; X124F, X124K, X124L, X124M, X124N, X124R, X124S, X124W; X126A, X126C, X126G, X126I, X126T; X132H; X136F, X136K, X136L, X136M, X136Y; X139E; X141A; X142M; X146R; X150L, X150S; X152A, X152C, X152F, X152G, X152I, X152L, X152R, X152S, X152W; X155C, X155I, X155L, X155T; X156A, X156F, X156S, X156T; X157L; X160L; X165L, X165N, X165V; X199L, X199V; X209F, X209M, X209Q, X209V; X210G, X210S; X215F, X215H, X215L; X217L; X223A, X223S, X223T, X223V; X265Y, X265W; X266N; X267V; X269L, X269T; X273D, X273H, X273M, X273R, X273V; X282I, X282L, X282T, X282V; X284A, X284P, X284S, X284T, X284V; X296D, X296L, X296R, X296S, X296W; X297D; and X297G.

In some embodiments, the transaminase polypeptide capable of converting compound 2 to compound 1 comprises an amino acid sequence having a specified amino acid identity described above and one or more residue differences as compared to SEQ ID NO:4 selected from: X52H; X54A; X54L; X56D; X56E; X61G; X61W; X62A; X62L; X62N; X62S; X117V; X122F; X122W; X122Y; X124K; X124M; X124S; X124W; X126C; X126I; X136K; X136L; X136M; X150L; X152A; X152F; X152R; X152W; X155 I; X155 L; X199L; X199V; X209F; X209M; X209Q; X209V; X215H; X215L; X223S; X223T; X223V; X269L; X273H; X282I; X282L; X282V; X284A; X284P; X284S; X284T; X284V; and X296D.

In some embodiments, the transaminase polypeptides with the residue differences above at residue positions selected from X52; X54; X56; X61; X62; X69; X117; X122; X124; X126; X136; X150; X152; X155; X199; X209; X215; X223; X223; X269; X273; X282I; X284A and X296 can further comprise one or more residue differences as compared to SEQ ID NO:4 at residue positions selected from X12; X13; X42; X54; X64; X68; X72; X80; X84; X103; X115; X127; X128; X134; X139; X140; X143; X156; X157; X159; X160; X165; X168; X176; X192; X196; X208; X227; X231; X266; X267; X295; X300; X311; X312; X320; X324; X325; and X327. In some embodiments, the amino acid residue differences for residue positions X12; X13; X42; X54; X64; X68; X72; X80; X84; X103; X115; X127; X128; X134; X139; X140; X143; X156; X157; X159; X160; X165; X168; X176; X192; X196; X208; X227; X231; X266; X267; X295; X300; X311; X312; X320; X324; X325; and X327 are selected from the following: X12H; X13A; X13F; X42G; X54P; X54R; X64C; X68I; X72A; X80Q; X84T; X103G; X115R; X127T; X128A; X134S; X139E; X140K; X143V; X156A; X156S; X156T; X157L; X159G; X160L; X165N; X168R; X176C; X192A; X192G; X192H; X192K; X192N; X192Q; X192R; X192S; X196L; X196V; X208K; X227I; X231T; X266N; X267V; X295S; X300G; X311T; X312C; X320G; X324Q; X325P; X325V; and X327L.

In some embodiments, the transaminase polypeptides with the one or more residue differences above at residue positions selected from X52; X54; X56; X61; X62; X69; X117; X122; X124; X126; X136; X150; X152; X155; X199; X209; X215; X223; X223; X269; X273; X282I; X284A and X296, and optionally additional residue differences at one or more of residue positions X12; X13; X42; X54; X64; X68; X72; X80; X84; X103; X115; X127; X128; X134; X139; X140; X143; X156; X157; X159; X160; X165; X168; X176; X192; X196; X208; X227; X231; X266; X267; X295; X300; X311; X312; X320; X324; X325; and X327, can further comprise one or more residue differences as compared to SEQ ID NO:4 selected from: X124N; X124L; X124F; X126A; X126T; and X136Y.

In some embodiments, the engineered transaminase polypeptide capable of converting compound 2 to compound 1 under suitable reaction conditions, comprises an amino acid sequence having at least at least 80%, 85%, 86%, 87%, 88%, 89%, 90%, 91%, 92%, 93%, 94%, 95%, 96%, 97%, 98%, 99% or more identity to reference sequence SEQ ID NO:2 and one or more residue differences as compared to SEQ ID NO:2 selected from: X12H; X13A; X13F; X52H; X54A; X54L; X56D; X56E; X61G; X61W; X62A; X62L; X62N; X62S; X64C; X68I; X72A; X80Q; X84T; X103G; X115R; X117V; X122F, X122W; X122Y; X124K; X124M; X124S; X124W; X126C; X126I; X127T; X128A; X134S; X136K; X136L; X136M; X139E; X140K; X143V; X150L; X152A; X152F; X152R; X152W; X155I; X155L; X159G; X168R; X176C; X192A; X192G; X192H; X192K; X192N; X192Q; X192R; X192S; X196L; X196V; X199L; X199V; X208K; X209F; X209M; X209Q; X209V; X215H; X215L; X223S; X223T; X223V; X227I; X231T; X266N; X269L; X273H; X282I; X282L; X282V; X284A; X284P; X284S; X284T; X284V; X295S; X296D; X300G; X311T; X312C; X320G; X324Q; X325P; X325V; and X327L.

In some embodiments, the engineered transaminase polypeptide capable of converting compound 2 to compound 1 under suitable reaction conditions, comprises an amino acid sequence having at least at least 80%, 80%, 85%, 86%, 87%, 88%, 89%, 90%, 91%, 92%, 93%, 94%, 95%, 96%, 97%, 98%, 99% or more identity to a reference sequence selected from the even-numbered sequence identifiers of SEQ ID NO: 4-854 and one or more residue differences as compared to SEQ ID NO:4 selected from: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X10L; X12H; X13A, X13F; X17L; X18I; X21L; X22A, X22H; X25A; X27L, X27H, X27P; X28N; X29N, X29T; X30F, X30G; X31H, X31R; X34V; X37S; X42G; X43S; X46R; X47R; X48A, X48G, X48R, X48S, X48W; X49I, X49P; X50S; X52H; X54A, X54L, X54M, X54P, X54R; X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P, X97T; X99L; X101G, X101L, X101R; X102H, X102R; X102T, X102W; X103G, X103N, X103V; X106L, X106S, X106T, X106V; X107V; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X136F, X136K, X136L, X136M, X136Y; X139E; X140A, X140K; X140M, X140T, X140V; X141A; X142M; X143V; X144D, X144I; X146R; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X192A, X192G, X192H, X192K, X192N, X192Q, X192R, X192S; X196L, X196V; X199L, X199V; X203M; X208K; X209F, X209M, X209Q, X209V; X210G, X210S; X215F, X215H, X215L; X217L; X223A, X223S, X223T, X223V; X227I; X231T; X233D; X234L; X241R; X256R; X260Q; X263V; X265Y, X265W; X266N; X267V; X269L, X269T; X270R, X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X297D; X297G; X300G, X300L; X305Q, X305T; X308A; X309L, X309T, X309W; X311Q, X311T; X312C, X312M; X316L, X316R; X319R, X319T, X319Y; X320G, X320Q; X323C, X323E, X323N, X323R; X324Q; X325M, X325P, X325Q, X325V; X327L, X327R; and X329P. In some embodiments, the reference sequence is selected from SEQ ID NO: 4, 6, 16, 60, 84, 186, 298, 372, 582, 696, 764, 798, 818, or 824. In some embodiments, the reference sequence is SEQ ID NO:4. In some embodiments, the reference sequence is SEQ ID NO:84. In some embodiments, the reference sequence is SEQ ID NO:372. In some embodiments, the reference sequence is SEQ ID NO:582. In some embodiments, the reference sequence is SEQ ID NO:696. In some embodiments, the reference sequence is SEQ ID NO: 764. In some embodiments, the reference sequence is SEQ ID NO: 798. In some embodiments, the reference sequence is SEQ ID NO: 818. In some embodiments, the reference sequence is SEQ ID NO: 824.

In some embodiments, the foregoing engineered transaminase polypeptide having one or more residue differences at residue positions X12; X13; X52; X54; X56; X61; X62; X64; X68; X72; X80; X84; X103; X115; X117; X122; X124; X126; X127; X128; X134; X136; X139; X140; X143; X150; X152; X155; X155; X159; X168; X176; X192; X196; X199; X208; X209; X215; X223; X227; X231; X266; X269; X273; X282; X282; X284; X284; X295; X296; X300; X311; X312; X320; X324; X325; X325; and X327, can further comprise one or more residue differences as compared to SEQ ID NO:4 selected from: X42G; X54P; X54R; X69A; X69G; X69T; X122M; X124F; X124L; X124N; X124R; X126A; X126T; X136Y; X136F; X150S; X152C; X152G; X152I; X152L; X152S; X156A; X156S; X156T; X157L; and X165N.

In some embodiments, the transaminase polypeptide comprises one or more amino acid residue differences selected from X122F; X122W; X122Y; X124K; X124M; X124S; X124W; X136K; X136L; X136M; X152A; X152F; X152R; X152W; X192A; X192G; X192H; X192K; X192N; X192Q; X192R; X192S; X209F; X209M; X209Q; X209V; X284A; X284P; X284S; X284T; and X284V.

In some embodiments, the transaminase polypeptide comprising an amino acid sequence having one or more residue differences as compare to SEQ ID NO:4 selected from X122F; X122W; X122Y; X124K; X124M; X124S; X124W; X136K; X136L; X136M; X152A; X152F; X152R; X152W; X192A; X192G; X192H; X192K; X192N; X192Q; X192R; X192S; X209F; X209M; X209Q; X209V; X284A; X284P; X284S; X284T; and X284V can further comprise one or more residue differences at residue positions selected from X12; X13; X42; X52; X54; X56; X61; X62; X64; X68; X69; X72; X80; X84; X103; X115; X117; X126; X127; X128; X134; X139; X140; X143; X150; X155; X156; X157; X159; X160; X165; X168; X176; X196; X199; X208; X215; X223; X227; X231; X266; X267; X269; X273; X282; X295; X296; X300; X311; X312; X320; X324; X325; and X327.

In some embodiment, the transaminase polypeptide capable of converting compound 2 to compound 1 comprises an amino acid sequence having an amino acid residue difference as compared to SEQ ID NO:4 at residue position X192. As noted above, residue position X192 is associated with substrate binding, and residue differences at this position increases transaminase enzyme activity. In some embodiments, the amino acid residue at X192 is selected from A, G, H, K, N, Q, R and S.

In some embodiments, the transaminase polypeptide comprising an amino acid sequence having an amino acid residue difference at residue position X192 further comprises one or more residue differences selected from the following: X5K; X5L; X21L; X66A; X122F; X122W; X122Y; X124F; X124K; X124L; X124M; X124N; X124R; X124S; X124W; X126G; X136F; X136K; X136L; X136M; X136Y; X152A; X152C; X152F; X152G; X152I; X152L; X152R; X152S; X152W; X191A; X209F; X209M; X209Q; X209V; X210S; X215F; X273R; X284A; X284P; X284S; X284T; X284V; and X323C.

In some embodiments, the transaminase polypeptide comprising an amino acid sequence having a residue difference at residue position X192 further comprises one or more residue differences at residue positions selected from X12; X13; X42; X52; X54; X56; X61; X62; X64; X68; X69; X72; X80; X84; X103; X115; X117; X126; X127; X128; X134; X139; X140; X143; X150; X155; X156; X157; X159; X160; X165; X168; X176; X196; X199; X208; X215; X223; X227; X231; X266; X267; X269; X273; X282; X295; X296; X300; X311; X312; X320; X324; X325; and X327.

In some embodiments, for the transaminase polypeptide above further comprising one or more residue differences at residue positions X12; X13; X42; X52; X54; X56; X61; X62; X64; X68; X69; X72; X80; X84; X103; X115; X117; X126; X127; X128; X134; X139; X140; X143; X150; X155; X156; X157; X159; X160; X165; X168; X176; X196; X199; X208; X215; X223; X227; X231; X266; X267; X269; X273; X282; X295; X296; X300; X311; X312; X320; X324; X325 and X327, the residue differences can be selected from: X12H; X13A; X13F; X42G; X52H; X54A; X54L; X54P; X54R; X56D; X56E; X61G; X61W; X62A; X62L; X62N; X62S; X64C; X68I; X69A; X69G; X69T; X72A; X80Q; X84T; X103G; X115R; X117V; X126A; X126C; X126I; X126T; X127T; X128A; X134H; X139E; X140K; X143V; X150L; X150S; X155I, X155L; X155T; X156A; X156S; X156T; X157L; X159G; X160L; X165N; X168R; X176C; X196L; X196V; X199L; X199V; X208K; X215H; X215L; X223S;

X223T; X223V; X227I; X231T; X266N; X267V; X269L; X273H; X282I; X282L; X282V; X295S; X296D; X300G; X311T; X312C; X320G; X324Q; X325P; X325V; and X327L.

Exemplary transaminase polypeptides with a residue difference as compared to SEQ ID NO:4 at residue position X192 can be selected from SEQ ID NO: 16, 18, 20, 26, 32, 34, 36, 38, 40, 42, 44, 46, 48, 50, 52, 54, 56, 58, 60, 62, 64, 66, 68, 70, 72, 74, 76, 78, 80, 82, 84, 136, 138, 140, 142, 144, 162, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, and even numbered sequence identifiers SEQ ID NO: 306-854.

In some embodiments, the transaminase polypeptides comprise a combination of residue difference associated with improved enzyme properties, as presented in the exemplary polypeptides. These include, among others, the combination of amino acid residue differences as compared to SEQ ID NO: 4 selected from: (a) X124W and X327L; (b) X209M and X300G; (c) X122F, X223V and X284A; (d) X192A, X215H and X311T; (e) X62N, X124F, X126A and X136L; (f) X124W, X126A, X136L, X192A and X284A; and (g) X124W, X126A, X136L, X152R/X152L/X152I, and X192A.

In some embodiments, the transaminase polypeptides capable of converting compound 2 to compound 1 comprises an amino acid sequence selected from the even-numbered sequence identifiers of SEQ ID NO: 6-854. In some embodiments, one or more of amino acid sequences selected from SEQ ID NO: 8, 100, 112, 114, 116, 118, and 126 are specifically excluded from the embodiments herein.

As noted above, the transaminase polypeptides described herein can have increased activity relative to the reference polypeptide of SEQ ID NO:4. In some embodiments, the polypeptides can be engineered to have increased activity for production of certain stereoisomers of compound 1. Tables 2A, 2B, 2C, 2D, 2E, 2F, 2G, 2H, and 2I provide exemplary polypeptides displaying increased activity for production of diastereomeric compounds 1d and 1a (i.e., [1d]+[1a]). Thus, in some embodiments, the transaminase polypeptides described herein are capable of converting compound 2 to compound 1d and compound 1a with at least 1.2 fold, 1.5 fold, 2 fold, 3 fold, 4 fold, 5 fold, 10 fold, 20 fold, 30 fold, 40 fold, 50 fold, 100 fold, 200 fold, 500 fold, 1000 fold or more relative to the activity of the reference polypeptide of SEQ ID NO: 4, under suitable reaction conditions.

As discussed above, residue positions X54; X56; X61; X62; X64; X68; X69; X122; X124; X126; X136; X139; X140; X143; X150; X155; X156; X157; X159; X160; X176; X192; X199; X209; X223; X227; X282; and X284 are associated with increases in enzyme activity and binding of substrate compound 2. Accordingly, in some embodiments, the engineered transaminases polypeptides has an amino acid sequence comprising one or more residue difference as compared to SEQ ID NO:4 selected from: X54A; X54L; X56D; X56E; X61G; X61W; X62A; X62L; X62N; X62S; X64C; X68I; X122F; X122W; X122Y; X124K; X124M; X124S; X124W; X126C; X126I; X136K; X136L; X136M; X139E; X140K; X143V; X150L; X155I; X155L; X159G; X160L; X176C; X192A; X192G; X192H; X192K; X192N; X192Q; X192R; X192S; X199L; X199V; X209F; X209M; X209Q; X209V; X223S; X223T; X223V; X227I; X282L; X282V; X284A; X284P; X284S; X284T; and X284V.

In some embodiments, the engineered transaminase polypeptide with one or more residue differences as compared to SEQ ID NO:4 at residue positions X54; X56; X61; X62; X64; X68; X122; X124; X126; X136; X139; X140; X143; X150; X155I; X159; X176; X192; X199; X209; X209; X223; X227; X282; X282; and X284 further comprises one or more residue differences selected from X54P; X54R; X69T; X69A; X69G; X122M; X124F; X124L; X124N; X124R; X126T; X126A; X136F; X136Y; X150S; X152A, X152C; X152F; X152G; X152I; X152L; X152R; X152S; X152W; X156A; X156S; X157L; and X282I.

In some embodiments, the transaminase polypeptide with the increased activity in converting compound 2 to compound 1d and compound 1a above, comprises an amino acid sequence with a combination of residue differences as compared to SEQ ID NO:4 selected from: (a) X136L and X192A; (b) X124L and X192A; (c) X124W, X126A, X136L, X192A, and X284A; (d) X122W, X124F, X126A, X192A and X284V; (e) X124W, X126A, X136L, X143V, X150S, X156T, X159G, X192A, X215H, X223S, and V227I; and (f) X54P, X64C, X124W, X126A, X139E, X143V, X155I, X157L, X159G, X192A, X199V, X215H and X227I.

In some embodiments, the transaminase polypeptide capable of converting compound 2 to compound 1d and compound 1a with at least 1.5 fold the activity of SEQ ID NO:4 comprises an amino acid sequence selected from the sequences having the even-numbered sequence identifiers of SEQ ID NO: 6-854.

In some embodiments, the transaminase polypeptide is capable of converting compound 2 to compound 1d and compound 1a with at least 10 fold the activity of SEQ ID NO:4. In some embodiments, the transaminase polypeptide with at least 10 fold the activity of SEQ ID NO:4 comprises an amino acid sequence selected from SEQ ID NO: 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 122, 124, 136, 138, 140, 144, 154, 162, 164, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, and the even numbered sequence identifiers of SEQ ID NO: 306-854.

In some embodiments, the transaminase polypeptide is capable of converting compound 2 to compound 1d and compound 1a with at least 100 fold the activity of SEQ ID NO:4. In some embodiments, the transaminase polypeptide with at least 100 fold the activity of SEQ ID NO:4 comprises an amino acid sequence selected from SEQ ID NO: 16, 26, 28, 30, 32, 34, 36, 38, 40, 42, 44, 46, 48, 50, 52, 54, 56, 60, 62, 64, 66, 68, 70, 72, 74, 76, 78, 80, 82, 84, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, and the even numbered sequence identifiers of SEQ ID NO: 306-854.

In some embodiments, the transaminase polypeptide is capable of converting compound 2 to compound 1d and compound 1a with at least 1000 fold the activity of SEQ ID NO:4. In some embodiments, the transaminase polypeptide with at least 1000 fold the activity of SEQ ID NO:4 comprises an amino acid sequence selected from SEQ ID NO: 34, 50, 52, 56, 62, 64, 66, 68, 70, 72, 74, 78, 80, 82, 84, 292, 294, 296, 298, 300, 302, and the even numbered sequence identifiers of SEQ ID NO: 306-854.

In addition, as discussed above, the transaminase polypeptides can be designed to have stereoselectivity for certain stereomeric products; that is produce one or a set of stereoisomers over another or another set of stereoisomers, as displayed by the exemplary polypeptides in Tables 2C, 2D, and 2I. Accordingly in some embodiments, the transaminase polypeptides are capable converting compound 2 to compound 1a and compound 1d in a diastereomeric ratio greater than 8:1, greater than 10:1, greater than 20:1, greater than 50:1, greater than 100:1 or more over compound 1b and compound 1c.

In some embodiments, the transaminase polypeptide capable of converting compound 2 to compound 1d and compound 1a in a diastereomeric ratio greater than 8:1 over compound 1b and compound 1c can have an amino acid sequence comprising one or more residue differences as compared to SEQ ID NO:4 selected from: X62N; X62A; X62S; X62L; X124W, X124F; X124K; X124L; X124M; X124N; X124R; X124S; X136F; X136K; X136L; X136M; X136Y; X152A; X152C; X152F; X152G; X152I; X152L; X152R; X152S; X152W; X192A; X192G; X192H; X192K; X192N; X192Q; X192R; X192S; X215H; X215L; X284V; X284A; X284P; X284S; and X284T.

In some embodiments, the transaminase polypeptide capable of converting compound 2 to compound 1a and compound 1d in a diastereomeric ratio greater than 8:1 over compound 1b and compound 1c can have an amino acid sequence comprising a combination of residue differences as compared to SEQ ID NO:4 selected from: (a) X124F/X124K/X124L/X124W and X192A/X192N/X192S; (b) X136F/X136L and X192A/X192N/X192S; (c) X124F/X124K/X124L/X124W, X192A/X192N/X192S and X284A/X284T/X284V; (d) X124F/X124K/X124L/X124W, X136F/X136L and X192A/X192N/X192S; (e) X124F/X124K/X124L/X124W, X126A, X136F/X136L, and X192A/X192N/X192S; and (f) X124F/X124K/X124L/X124W, X126A, X136F/X136L, X192A/X192N/X192S, and X284A/X284T/X284V.

In some embodiments, the transaminase polypeptide capable of converting compound 2 to compound 1a and compound 1d in a diastereomeric ratio greater than 8:1 over compound 1b and compound 1c comprises an amino acid sequence selected from SEQ ID NO: 6, 10, 12, 14, 16, 18, 20, 22, 24, 26, 30, 32, 34, 36, 38, 40, 42, 44, 46, 48, 50, 52, 54, 56, 58, 60, 62, 64, 66, 68, 70, 72, 74, 76, 78, 80, 82, 84, 372, 412, 526, 528, 550, 580, 582, 624, 630, 640, 648, 654, 656, 668, 692, 696, 700, 704, 714, 716, 718, 720, 742, 764, 774, 798, 818, 824, and 826.

In some embodiments, the transaminase polypeptide is capable of converting compound 2 to compound 1a and compound 1d in a diastereomeric ratio greater than 50:1 over compound 1b and compound 1c. In some embodiments, the transaminase polypeptide capable of converting compound 2 to compound 1a and compound 1d in a diastereomeric ratio greater than 50:1 over compound 1b and compound 1c comprises an amino acid sequence selected from SEQ ID NO: 6, 16, 18, 20, 22, 24, 26, 30, 32, 34, 36, 42, 46, 48, 50, 52, 56, 58, 60, 62, 64, 68, 74, 76, 78, 80, 82, 84, 372, 412, 550, 580, 582, 624, 630, 640, 648, 654, 656, 668, 692, 696, 700, 704, 764, 774, 798, 818, 824, and 826.

In some embodiments, the transaminase polypeptide is capable of converting compound 2 to compounds 1a and compound 1d in a diastereomeric ratio greater than 100:1 over compound 1b and compound 1c. In some embodiments, the transaminase polypeptide capable of converting compound 2 to compounds 1a and compound 1d in a diastereomeric ratio greater than 100:1 over compound 1b and compound 1c comprises an amino acid sequence selected from SEQ ID NO: 16, 18, 20, 26, 30, 34, 36, 42, 48, 50, 52, 58, 64, 68, 76, 78, 80, 82, 84, 582, 640, 648, 654, 668, 696, 700, 764, 774, 798, and 818.

In some embodiments, the transaminase polypeptide is capable of converting compound 2 to compound 1d in diastereomeric excess of compound 1a. These polypeptides can be designed in like manner as other stereoselective polypeptides using the information from the properties of the exemplary polypeptides above. In some embodiments, the amino acid sequence of the transaminase polypeptide capable of converting compound 2 to compound 1d in diastereomeric excess over compound 1a comprises one or more amino acid residue differences as compared to SEQ ID NO:4 selected from X62N; X122F; X122W; X209M; X284V, X284T, X284A; X284P and X284S.

In some embodiments, the transaminase polypeptide capable of converting compound 2 to compound 1d in diastereomeric excess over compound 1a comprises a combination of amino acid residue differences as compared to SEQ ID NO:4 selected from the following: (a) X192A and G284T; (b) X62N, X124F, X126A and X136L; (c) X122W, X124F, X192A, X209M and X284V; (d) X122W, X124F, X126A, X192A and X284V; (e) X122F, X124F, X136L, X152F, X209M and X284V; (f) X124F, X126A, X136L, X152A, X192S and X284V; and (g) X122F, I124W, X160L, X192A, X209M and X284V.

In some embodiments, the transaminase polypeptide capable of converting compound 2 to compound 1d in diastereomeric excess over compound 1a comprises an amino acid sequence selected from: SEQ ID NO: 6, 8, 10, 12, 14, 22, 24, 28, 30, 32, 44, 48, 50, and 52.

In some embodiments, the transaminase polypeptide is capable of converting compound 2 to compound 1d in at least 50% diastereomeric excess over compound 1a. In some embodiments, the transaminase polypeptide capable of converting compound 2 to compound 1d in at least 50% diastereomeric excess over compound 1e comprises an amino acid sequence selected from SEQ ID NO: 6, 14, 22, 24 and 28.

In some embodiments, the transaminase polypeptides can have diastereoselectivity for compound 1a over compound 1d. Data from the exemplary transaminases polypeptides in Tables 2C, 2D, and 21 indicate that polypeptides with diastereoselectivity for compound 1a over compound 1d are associated with residue differences as compared to SEQ ID NO:4 of the following: X54P; X54L; X64C; X140K; X143V; X150S; X155I; X156T; X215H; X223S; X227I; and the combination of X124W and X126A. Accordingly, in some embodiments, transaminases polypeptides capable of converting compound 2 to compound 1a in diastereomeric excess of compound 1d has an amino acid sequence comprising one or more residue differences as compared to SEQ ID NO:4 selected from: X54P; X54L; X64C; X140K; X143V; X150S; X155I; X156T; X215H, X223S; X227I; and the combination of X124W and X126A.

In some embodiments, the transaminase polypeptide capable of converting compound 2 to compound 1a in diastereomeric excess over compound 1d comprises a combination of residue differences as compared to SEQ ID NO:4 selected from: (a) X192A/X192S and X215H; (b) X124W, X126A, X136L/X136F and X192A/X192N/X192S; (c) X124W, X126A, X136L, X152L/X152W/X152I, and X192A; (d) X54L, X124W, X126A, X136L, X192A, X215H, and X223S; (e) X54L, X64C, X124W, X126A, X136L, X192A, and X215H; (f) X124W, X126A, X136L, X140K, X150S, X155I, X192A, X196L, X215H, and X227I; (g) X54L, X124W, X126A, X136L, X155I, X156T, X157L, X192A, X215H, and X223S; (h) X54P, X64C, X124W, X126A, X136L, X155I, X156T, X157L, X192A, and X215H; (i) X124W, X126A, X136L, X143V, X150S, X156T, X159G, X192A, X215H, X223S, and X227I; (j) X54P, X56E, X64C, X124W, X126A, X136L, X139E, X140K, X143V, X150S, X156T, X192A, and X215H; and (k) X124W, X126A, X136L, X140K, X143V, X155I, X156T, X157L, X192A, X199V, X215H, X223S, X227I, and X231T.

In some embodiments, the transaminase polypeptide with diastereoselectivity for compound 1a over compound 1d comprises an amino acid sequence selected from: SEQ ID NO: 16, 18, 20, 26, 34, 42, 46, 56, 58, 60, 62, 64, 68, 70, 72, 74, 76, 78, 80, 82, and 84.

In some embodiments, the non-naturally occurring transaminase polypeptide capable of converting compound 2 to compound 1 under suitable reaction conditions, comprises an amino acid sequence having at least 80%, 85%, 86%, 87%, 88%, 89%, 90%, 91%, 92%, 93%, 94%, 95%, 96%, 97%, 98%, or 99% identity to one of the sequences having the even-numbered sequence identifiers of SEQ ID NO: 6-854, and the amino acid residue differences as compared to SEQ ID NO:4 present in any one of the sequences having the even-numbered sequence identifiers of SEQ ID NO: 6-854. As described above, in some embodiments, residue differences present in one or more of amino acid sequences selected from SEQ ID NO: 8, 100, 112, 114, 116, 118, and 126 are specifically excluded from the embodiments.

In addition to the residue positions specified above, any of the engineered transaminase polypeptides disclosed herein can further comprise residue differences relative to the reference polypeptide sequence of SEQ ID NO: 4 at other residue positions i.e., residue positions other than X2; X4; X5; X6; X8; X9; X10; X12; X13; X17; X18; X21; X22; X25; X27; X28; X29; X30; X31; X34; X37; X42; X43; X46; X47; X48; X49; X50; X52; X54; X55; X56; X61; X62; X64; X66 X68; X69; X72; X80; X81; X84; X85; X88; X97; X99; X101; X102; X103; X106; X107; X108; X115; X117; X120; X122; X124; X126; X127; X128; X131; X132; X134; X136; X139; X140; X141; X142; X143; X144; X146; X150; X152; X155; X156; X157; X159; X160; X161; X165; X168; X176; X179; X185; X190; X191; X192; X196; X199; X208; X209; X210; X215; X217; X223; X227; X231; X233; X234; X241; X256; X260; X263; X265; X266; X267; X269; X270; X273; X274; X282; X284; X295; X296; X297; X300; X305; X308; X309; X311; X312; X316; X319; X320; X323; X324; X325; X327; and X329. Residue differences at these other residue positions can provide for additional variations in the amino acid sequence without altering the polypeptide's ability to convert a compound 2 to compound 1, in particular with regards to increased activity for producing compound 1a and compound 1d; diastereoselectivity for compound 1a and compound 1d over compound 1b and compound 1c; diastereoselectivity for compound 1d over compound 1a; and/or diastereoselectivity for compound 1a over compound 1d. Accordingly, in some embodiments, in addition to the amino acid residue differences of any one of the engineered transaminase polypeptides selected from the polypeptides having the even-numbered sequence identifiers of SEQ ID NO: 6-854, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, 1-50, 1-55, or 1-60 residue differences at other amino acid residue positions as compared to the SEQ ID NO:4. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 residue positions. In some embodiments, the residue differences at other amino acid residue positions can comprise conservative substitutions and/or non-conservative substitutions as compared to a reference sequence of the wild-type polypeptide of SEQ ID NO: 2 or the engineered polypeptide of SEQ ID NO: 4.

Amino acid residue differences at other positions relative to the wild-type sequence of SEQ ID NO: 2 and the affect of these differences on enzyme function are described for other engineered transaminase polypeptides disclosed in published PCT applications WO2010/099501A2 and WO2011/005477A1; and PCT application PCT/US11/46932, filed Aug. 8, 2011; all of which are incorporated by reference herein. Accordingly, in some embodiments, one or more of the amino acid differences as compared to the wild-type sequence of SEQ ID NO: 2 can also be introduced into a engineered transaminase polypeptide of the present disclosure at residue positions selected from X2; X4; X5; X7; X8; X9; X10; X11; X14; X18; X22; X25; X26; X27; X28; X30; X37; X38; X41; X44; X48; X49; X50; X55; X58; X60; X65; X81; X82; X94; X96L; X102; X108; X120; X135; X137; X138; X141; X142; X146; X148; X163; X163; X164; X169; X171; X178; X181; X182; X204; X209; X210; X211; X213; X215; X217; X218; X223; X225; X230; X242; X245; X252; X265; X292; X297; X302; X306; X321; X328 and X329. In particular, the choices of amino acid residues at the forgoing positions can be selected from the following: X2K, X2Q, X2S; X4Y, X4I; X5K, X5H, X5I, X5L, X5N, X5S, X5T, X5V; X7A; X8P, X8T; X9N, X9Q, X9S; X10V; X11K; X14R; X18C; X22I; X25Q; X26H; X27T; X28P; X30M, X30Q; X37R; X38G; X41H, X41S; X41F; X44Q, X44V; X48A; X48D, X48G, X48Q, X48V; X49T; X50L; X55V, X55L; X58L; X60F; X65A, X65T, X65C, X65G, X65S; X81G; X82S; X94I, X94L; X96L; X102L, X102K; X108V; X120Y; X135Q; X137T, X137I; X138K, X138P; X141L; X142R, X142T; X146R; X148A, X148F; X163H, X163V; X164P, X164V; X164A; X169L; X171A; X178S; X181G; X182T; X204A; X209L; X209C, X209D, X209E; X210S; X211I; X213P; X215F, X215Y, X215C; X217N, X217S; X218M; X223I, X223L, X223M, X223N, X223P; X225Y; X230V; X242T; X245S; X252F; X265T; X292T; X297S; X302A; X306L; X321P; X328I; and X329H. Guidance on the choice of the amino acid residues at the residue positions can be found in the cited references.

As discussed above, the polypeptide sequence of SEQ ID NO: 4 used as the starting backbone for generating the exemplary engineered transaminase polypeptides is also an engineered transaminase polypeptide having the following 24 amino acid differences relative to the naturally occurring transaminase of Arthrobacter sp. KNK168 (SEQ ID NO: 2): S8P; Y60F; L61Y; H62T; V65A; D81G; M94I; I96L; F122I; S124I; G136W; A169L; V199I; A209L; G215C; G217N; S223P; L269P; L273Y; T282S; A284G; P297S; I306V; and S321P. Thus, in some embodiments, the engineered polypeptide capable of converting compound 2 to compound 1 under suitable reaction conditions and comprising an amino acid sequence having at least 80%, 85%, 86%, 87%, 88%, 89%, 90%, 91%, 92%, 93%, 94%, 95%, 96%, 97%, 98%, or 99% identity to a reference amino acid sequence selected from any one of the sequences having the even-numbered sequence identifiers of SEQ ID NO: 6-854, and has an amino acid sequence that does not include a residue difference as compared to SEQ ID NO: 4 at one or more of the following positions: X8; X60; X61; X62; X65; X81; X94; X96; X122; X124; X136; X169; X199; X209; X215; X217; X223; X269; X273; X282; X284; X297; X306; and X321.

In some embodiments, the present disclosure also provides engineered transaminase polypeptides that comprise a fragment of any of the engineered transaminase polypeptides described herein that retains the functional activity and/or improved property of that engineered transaminase. Accordingly, in some embodiments, the present disclosure provides a polypeptide fragment capable of converting compound 2 to compound 1 under suitable reaction conditions, wherein the fragment comprises at least about 80%, 90%, 95%, 98%, or 99% of a full-length amino acid sequence of a engineered transaminase polypeptide of the present disclosure, such as an exemplary engineered polypeptide of having the even-numbered sequence identifiers of SEQ ID NO: 6-854.

In some embodiments, the engineered transaminase polypeptide of the disclosure can have an amino acid sequence comprising a deletion as compared to any one of the engineered transaminase polypeptide sequences described herein, such as the exemplary engineered polypeptide sequences having the even-numbered sequence identifiers of SEQ ID NO: 6-854. Thus, for each and every embodiment of the engineered transaminase polypeptides of the disclosure, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the transaminase polypeptides, where the associated functional activity and/or improved properties of the engineered transaminase described herein is maintained. In some embodiments, the deletions can comprise, 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, 1-50, 1-55, or 1-60 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, 50, 55, or 60 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, 25 or 30 amino acid residues.

In some embodiments, the present disclosure provides an engineered transaminase polypeptide having an amino acid sequence comprising an insertion as compared to any one of the engineered transaminase polypeptide sequences described herein, such as the exemplary engineered polypeptide sequences having the even-numbered sequence identifiers of SEQ ID NO: 6-854. Thus, for each and every embodiment of the transaminase polypeptides of the disclosure, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, where the associated functional activity and/or improved properties of the engineered transaminase described herein is maintained. The insertions can be to amino or carboxy terminus, or internal portions of the transaminase polypeptide.

In some embodiments, the present disclosure provides a non-naturally occurring polypeptide capable of converting compound 2 to compound 1 under suitable reaction conditions, which comprises an amino acid sequence having at least 80%, 85%, 86%, 87%, 88%, 89%, 90%, 91%, 92%, 93%, 94%, 95%, 96%, 97%, 98%, or 99% identity to the sequences having the even-numbered sequence identifiers of SEQ ID NO: 6-854, with the proviso that the amino acid sequence is not identical to (that is, it excludes) any of the exemplary engineered transaminase polypeptides amino acid sequences disclosed in published PCT applications WO2010/099501A2 and WO2011/005477A1; and PCT application PCT/US11/46932, filed Aug. 8, 2011; all of which are incorporated by reference herein.

In the above embodiments, the suitable reaction conditions for the engineered polypeptides are those described in Tables 2A, 2B, 2C, 2D, 2E, 2F, 2G, or 2H. Accordingly, in some embodiments, the suitable reaction conditions comprise 5 g/L compound 2, 15 g/L or less of transaminase polypeptide, 20% dimethylsulfoxide (DMSO), 1M isopropylamine (IPM), 1 g/L pyridoxal phosphate (PLP), 0.2 M borate, pH 10.5 and 45° C. for 72 h. In some embodiments, the suitable reaction conditions comprise 5 g/L compound 2, 5 g/L or less of transaminase polypeptide, 20% dimethylsulfoxide (DMSO), 1 M isopropylamine (IPM), 1 g/L pyridoxal phosphate (PLP), 0.2 M borate, pH 10.5 and 45° C. for 24 h. In some embodiments, the suitable reaction conditions comprise 50 g/L compound 2, 25 g/L or less of transaminase polypeptide, 50% dimethylsulfoxide (DMSO), 1 M isopropylamine (IPM), 1 g/L pyridoxal phosphate (PLP), 0.2 M borate, pH 10.5 and 45° C. for 24 h. Guidance for use of these reaction conditions and the transaminase polypeptides are provided in, among others, Tables 2A, 2B, 2C, 2D, 2E, 2F, 2G, or 2H. and the Examples.

In some embodiments, the polypeptides of the disclosure can be in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

The engineered transaminase polypeptides described herein are not restricted to the genetically encoded amino acids. Thus, in addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereoisomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutamic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, CRC Practical Handbook of Biochemistry and Molecular Biology, CRC Press, Boca Raton, Fla., at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys (methylbenzyl), Cys (nitropyridinesulfenyl), Glu(δ-benzylester), Gln(xanthyl), Asn(N-δ-xanthyl), His(bom), His(benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the transaminase polypeptides are bound or immobilized on the solid support such that they retain their improved activity, enantioselectivity, stereoselectivity, and/or other improved properties relative to the reference polypeptide of SEQ ID NO: 4. In such embodiments, the immobilized polypeptides can facilitate the biocatalytic conversion of the substrate of compound 2 to the product of compound 1 (e.g., as shown in the processes for preparing compound 3 of Schemes 1 and 2 described herein), and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the transaminase polypeptides of the present disclosure can be carried out using the same transaminase polypeptides bound or immobilized on a solid support.

The transaminase polypeptide can be bound non-covalently or covalently. Various methods for conjugation and immobilization of enzymes to solid supports (e.g., resins, membranes, beads, glass, etc.) are well known in the art and described in e.g., Yi et al., "Covalent immobilization of w-transaminase from *Vibrio fluvialis* JS17 on chitosan beads," Process Biochemistry 42(5): 895-898 (May 2007); Martin et al., "Characterization of free and immobilized (S)-aminotransferase for acetophenone production," *Applied Microbiology and Biotechnology* 76(4): 843-851 (September 2007); Koszelewski et al., "Immobilization of ω-transaminases by encapsulation in a sol-gel/celite matrix," *Journal of Molecular Catalysis B: Enzymatic,* 63: 39-44 (April 2010); Truppo et al., "Development of an Improved Immobilized CAL-B for the Enzymatic Resolution of a Key Intermediate to Odanacatib," *Organic Process Research & Development*, published online: dx.doi.org/10.1021/op200157c; Hermanson, G. T., Bioconjugate Techniques, Second Edition, Academic Press (2008); Mateo et al., "Epoxy sepabeads: a novel epoxy support for stabilization of industrial enzymes via very intense multipoint covalent attachment," *Biotechnology Progress* 18(3):629-34 (2002); and Bioconjugation Protocols: Strategies and Methods, In Methods in Molecular Biology, C. M. Niemeyer ed., Humana Press (2004); the disclosures of each which are incorporated by reference herein. Solid supports useful for immobilizing the engineered transaminases of the present disclosure include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered transaminases of the present disclosure include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the transaminase polypeptides can be provided in the form of an array in which the polypeptides are arranged in positionally distinct locations. In some embodiments, the positionally distinct locations are wells in a solid support such as a 96-well plate. A plurality of supports can be configured on an array at various locations, addressable for robotic delivery of reagents, or by detection methods and/or instruments. Such arrays can be used to test a variety of substrate compounds for conversion by the polypeptides.

In some embodiments, the engineered polypeptides described herein can be provided in the form of kits. The polypeptides in the kits may be present individually or as a plurality of polypeptides. The kits can further include reagents for carrying out enzymatic reactions, substrates for assessing the activity of polypeptides, as well as reagents for detecting the products. The kits can also include reagent dispensers and instructions for use of the kits. In some embodiments, the kits of the present disclosure include arrays comprising a plurality of different engineered transaminase polypeptides at different addressable position, wherein the different polypeptides are different variants of a reference sequence each having at least one different improved enzyme property. Such arrays comprising a plurality of engineered polypeptides and methods of their use are described in, e.g., WO2009/008908A2.

5.4 Polynucleotides, Control Sequences, Expression Vectors, and Host Cells Useful for Preparing Engineered Transaminase Polypeptides In another aspect, the present disclosure provides polynucleotides encoding the engineered transaminase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered transaminase can be introduced into appropriate host cells to express the corresponding transaminase polypeptide.

As will be apparent to the skilled artisan, availability of a protein sequence and the knowledge of the codons corresponding to the various amino acids provide a description of all the polynucleotides capable of encoding the subject protein sequence. The degeneracy of the genetic code, where the same amino acids are encoded by alternative or synonymous codons allows an extremely large number of nucleic acids to be made, all of which encode the improved transaminase enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences of the exemplary engineered polypeptides provided in Tables 2A, 2B, 2C, 2D, 2E, 2F, 2G, 2H, and 2I and disclosed in the sequence listing incorporated by reference herein as the sequences of the even-numbered sequence identifiers of SEQ ID NO: 6-854. As described herein, in some embodiments, excluded from the embodiments of the polynucleotides are sequences encoding one or more of amino acid sequences selected from SEQ ID NO: 8, 100, 112, 114, 116, 118, and 126.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the transaminases since the natural sequence will comprise preferred codons and because use of preferred codons may not be required for all amino acid residues. Consequently, codon optimized polynucleotides encoding the transaminase enzymes may contain preferred codons at about 40%, 50%, 60%, 70%, 80%, or greater than 90% of codon positions of the full length coding region.

In some embodiments, the polynucleotide encodes a transaminase polypeptide comprising an amino acid sequence that is at least about 80%, 85%, 86%, 87%, 88%, 89%, 90%, 91%, 92%, 93%, 94%, 95%, 96%, 97%, 98%, 99%, or more identical to a reference sequence selected from the even-numbered sequence identifiers of SEQ ID NO: 4-854, where the polypeptide has transaminase activity and one or more of the improved properties as described herein, for example the ability to convert compound 2 to product compound 1a and compound 1d with increased activity compared to the polypeptide of SEQ ID NO:4; converting compound 2 to compound 1a and compound 1d in diastereomeric ratio greater than 8:1 over compound 1b and compound 1c; and/or converting compound 2 to compound 1d in diastereomeric excess over compound 1a or converting compound 2 to compound 1a in diastereomeric excess of compound 1d. In some embodiments, the reference sequence is selected from SEQ ID NO: 4, 6, 16, 34, 60, 84, 186, 298, 372, 582, 696, 764, 798, 818, or 824. In some embodiments, the reference sequence is SEQ ID NO:4. In some embodiments, the reference sequence is SEQ ID NO:84. In some embodiments, the reference sequence is SEQ ID NO:372. In some embodiments, the reference sequence is SEQ ID NO:582. In some embodiments, the reference sequence is SEQ ID NO:696. In some embodiments, the reference sequence is SEQ ID NO: 764. In some embodiments, the reference sequence is SEQ ID NO: 798. In some embodiments, the reference sequence is SEQ ID NO: 818. In some embodiments, the reference sequence is SEQ ID NO: 824.

In some embodiments, the polynucleotide encodes an engineered transaminase polypeptide comprising an amino acid sequence that has the percent identity described above and (a) has one or more amino acid residue differences as compared to SEQ ID NO: 4 at residue positions selected from: X6, X10, X12, X13, X17, X21, X29, X31, X34, X43, X46, X47, X64, X66, X68, X72, X80, X84, X85, X88, X97, X99, X101, X103, X106, X107, X115, X127, X128, X131, X134, X139, X140, X143, X144, X159, X161, X168, X176, X179, X185, X190, X191, X192, X196, X208, X227, X231, X233, X234, X241, X256, X260, X263, X266, X270, X274, X295, X300, X305, X308, X309, X311, X312, X316, X319, X320, X323, X324, X325, and X327, or (b) one or more amino acid residue differences as compared to SEQ ID NO:4 selected from: X52H; X54A; X54L; X56D; X56E; X61G; X61W; X62A; X62L; X62N; X62S; X117V; X122F; X122W; X122Y; X124K; X124M; X124S; X124W; X126C; X126I; X136K; X136L; X136M; X150L; X152A; X152F; X152R; X152W; X155 I; X155 L; X199L; X199V; X209F; X209M; X209Q; X209V; X215H; X215L; X223S; X223T; X223V; X269L; X273H; X282I; X282L; X282V; X284A; X284P; X284S; X284T; X284V; and X296D. In some embodiments, the polynucleotide encodes an engineered transaminase polypeptide comprising an amino acid sequence that has the percent identity described above and one or more residue differences as compared to SEQ ID NO:4 selected from: X12H; X13A; X13F; X52H; X54A; X54L; X56D; X56E; X61G; X61W; X62A; X62L; X62N; X62S; X64C; X68I; X72A; X80Q; X84T; X103G; X115R; X117V; X122F; X122W; X122Y; X124K; X124M; X124S; X124W; X126C; X126I; X127T; X128A; X134S; X136K; X136L; X136M; X139E; X140K; X143V; X150L; X152A; X152F; X152R; X152W; X155I; X155L; X159G; X168R; X176C; X192A; X192G; X192H; X192K; X192N; X192Q; X192R; X192S; X196L; X196V; X199L; X199V; X208K; X209F; X209M; X209Q; X209V; X215H; X215L; X223S; X223T; X223V; X227I; X231T; X266N; X269L; X273H; X282I; X282L; X282V; X284A; X284P; X284S; X284T; X284V; X295S; X296D; X300G; X311T; X312C; X320G; X324Q; X325P; X325V; and X327L.

In some embodiments, the polynucleotide encoding the engineered transaminase comprises a sequence selected from the odd-numbered sequence identifiers of SEQ ID NO: 5-853. In some embodiments, specifically excluded are one or more polynucleotide sequences selected from SEQ ID NO: 7, 99, 111, 113, 115, 117, and 125.

In some embodiments, the present disclosure provides a polynucleotide that hybridizes under defined conditions, such as moderately stringent or highly stringent conditions, to a polynucleotide sequence (or complement thereof) encoding an engineered transaminase of the present disclosure. In some embodiments, the polynucleotides are capable of hybridizing under highly stringent conditions to a polynucleotide selected from the sequences having the odd-numbered sequence identifiers of SEQ ID NO: 5-853, or a complement thereof, and encodes a polypeptide having transaminase activity with one or more of the improved properties described herein. In some embodiments, the polynucleotide capable of hybridizing under highly stringent conditions encodes a transaminase polypeptide comprising an amino acid sequence that has one or more amino acid residue differences as compared to a reference polypeptide of SEQ ID NO: 2 or 4 at amino acid residue positions selected from the following: X6, X10, X12, X13, X17, X21, X22, X29, X31, X34, X43, X47, X64, X66, X68, X72, X80, X84, X85, X88, X97, X103, X115, X127, X128, X131, X134, X139, X140, X142, X143, X159, X161, X168, X176, X179, X185, X190, X191, X192, X196, X208, X210, X227, X231, X233, X234, X241, X265, X266, X270, X274, X295, X300, X305, X308, X309, X311, X312, X316, X319, X320, X323, X324, X325, and X327, or (b) one or more amino acid residue differences as compared to SEQ ID NO:4 selected from: X52H; X54A; X54L; X56D; X56E; X61G; X61W; X62A; X62L; X62N; X62S; X117V; X122F; X122W; X122Y; X124K; X124M; X124S; X124W; X126C; X126I; X136K; X136L; X136M; X150L; X152A; X152F; X152R; X152W; X155 I; X155 L; X199L; X199V; X209F; X209M; X209Q; X209V; X215H; X215L; X223S; X223T; X223V; X269L; X273H; X282I; X282L; X282V; X284A; X284P; X284S; X284T; X284V; and X296D. In some embodiments, the polynucleotide capable of hybridizing under highly stringent conditions encodes a transaminase polypeptide that has the percent identity described above and one or more residue differences as compared to SEQ ID NO:4 selected from: X12H; X13A; X13F; X52H; X54A; X54L; X56D; X56E; X61G; X61W; X62A; X62L; X62N; X62S; X64C; X68I; X72A; X80Q; X84T; X103G; X115R; X117V; X122F, X122W; X122Y; X124K; X124M; X124S; X124W; X126C; X126I; X127T; X128A; X134S; X136K; X136L; X136M; X139E; X140K; X143V; X150L; X152A, X152F; X152R; X152W; X155I; X155L; X159G; X168R; X176C; X192A; X192G; X192H; X192K; X192N; X192Q; X192R; X192S; X196L; X196V; X199L; X199V; X208K; X209F; X209M; X209Q; X209V; X215H; X215L; X223S; X223T; X223V; X227I; X231T; X266N; X269L; X273H; X282I; X282L; X282V; X284A; X284P; X284S; X284T; X284V; X295S; X296D; X300G; X311T; X312C; X320G; X324Q; X325P; X325V; and X327L.

In some embodiments, the polynucleotides encode the polypeptides described herein but have about 50%, 55%, 60%, 65%, 70%, 75%, 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered transaminase polypeptide. In some embodiments, the reference polynucleotide sequence is selected from the sequences having the odd-numbered sequence identifiers of SEQ ID NO: 5-853.

An isolated polynucleotide encoding an engineered transaminase polypeptide may be manipulated in a variety of ways to provide for expression of the polypeptide, including further sequence alteration by codon-optimization to improve expression, insertion in a suitable expression with or without further control sequences, and transformation into a host cell suitable for expression and production of the polypeptide.

Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, Molecular Cloning: A Laboratory Manual, 3$^{rd}$ Ed., Cold Spring Harbor Laboratory Press; and Current Protocols in Molecular Biology, Ausubel. F. ed., Greene Pub. Associates, 1998, updates to 2010.

The polynucleotides disclosed herein can further comprise a promoter sequence depending on the particular cellular production system used. For bacterial host cells, suitable promoters for directing transcription of the nucleic acid constructs of the present disclosure, include, among others, the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, Proc. Natl Acad. Sci. USA 75: 3727-3731), and the tac promoter (DeBoer et al., 1983, Proc. Natl Acad. Sci. USA 80: 21-25). For filamentous fungal host cells, suitable promoters for directing the transcription of the nucleic acid constructs of the present disclosure include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. In a yeast host, useful promoters can be from the genes for *Saccharomyces cerevisiae* enolase (ENO-1), *Saccharomyces cerevisiae* galactokinase (GALL), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present disclosure. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a non-translated region of an mRNA that is important for translation by the host cell. The leader sequence is operably linked to the 5' terminus of the nucleic acid sequence encoding the polypeptide. Any leader sequence that is functional in the host cell of choice may be used. Exemplary bacterial leader sequences can use the pelB leader sequence (Lei et al., 1987, J Bacteriol. 169(9):4379-4383) and leader sequences of dsbA, dsbC, Bce, CupA2, CupB2 of *Pseudomonas fluorescens* (U.S. Pat. No. 7,618,799). Exemplary leader sequences for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present disclosure. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, Mol Cell Bio 15:5983-5990. Exemplary mammalian polyadenylation sequences can be found in Zhang et al., 2005, Nucleic Acids Res. 33:D116-D120.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used. Effective signal peptide coding regions for bacterial host cells are the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiol Rev 57: 109-137. Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells can be from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a pro-enzyme or pro-polypeptide (or a zymogen in some cases). A pro-polypeptide can be converted to a mature active polypeptide by catalytic or autocatalytic cleavage of the pro-peptide from the pro-polypeptide. The pro-peptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836). Where both signal peptide and propeptide regions are present at the amino terminus of a polypeptide, the pro-peptide region is positioned next to the amino terminus of a polypeptide and the signal peptide region is positioned next to the amino terminus of the pro-peptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter. Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the polypeptide of the present disclosure would be operably linked with the regulatory sequence.

In another aspect, the present disclosure is also directed to a recombinant expression vector comprising a polynucleotide encoding an engineered transaminase polypeptide or a variant thereof, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids. The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present disclosure can include one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers which confer antibiotic resistance such as ampicillin, kanamycin, chloramphenicol, or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenylytransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

The expression vectors of the present disclosure also can include an element(s) that permits integration of the vector into the host cell's genome or autonomous replication of the vector in the cell independent of the genome. For integration into the host cell genome, the vector may rely on the nucleic acid sequence encoding the polypeptide or any other element of the vector for integration of the vector into the genome by homologous or non-homologous recombination.

Alternatively, the expression vector may contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements should preferably contain a sufficient number of nucleic acids, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A on or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it function in a temperature-sensitive manner in the host cell (see, e.g., Ehrlich, 1978, Proc Natl Acad Sci. USA 75:1433).

More than one copy of a nucleic acid sequence of the present disclosure may be inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many expression vectors useful with the embodiments of the present disclosure are commercially available. Suitable commercial expression vectors include p3xFLAGTM™ expression vectors from Sigma-Aldrich Chemicals, which includes a CMV promoter and hGH polyadenylation site for expression in mammalian host cells and a pBR322 origin of replication and ampicillin resistance markers for amplification in *E. coli*. Other suitable expression vectors are pBluescriptII SK(–) and pBK-CMV, which are commercially available from Stratagene, LaJolla CA, and plasmids which are derived from pBR322 (Gibco BRL), pUC (Gibco BRL), pREP4, pCEP4 (Invitrogen) or pPoly (Lathe et al., 1987, Gene 57:193-201).

An exemplary expression vector can be prepared by operatively linking a polynucleotide encoding an improved transaminase into the plasmid pCK110900I which contains the lac promoter under control of the lad repressor. The expression vector also contains the P15a origin of replication and the chloramphenicol resistance gene.

In another aspect, the present disclosure provides a host cell comprising a polynucleotide encoding an improved transaminase polypeptide of the present disclosure, the polynucleotide being operatively linked to one or more control sequences for expression of the transaminase enzyme in the host cell. Host cells for use in expressing the polypeptides encoded by the expression vectors of the present disclosure are well known in the art and include but are not limited to, bacterial cells, such as *E. coli, Arthrobacter* sp. KNK168, *Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. An exemplary host cell is *Escherichia coli* W3110 (ΔfhuA). Appropriate culture mediums and growth conditions for the above-described host cells are well known in the art.

Polynucleotides for expression of the transaminase may be introduced into cells by various methods known in the art. Techniques include among others, electroporation, biolistic particle bombardment, liposome mediated transfection, calcium chloride transfection, and protoplast fusion. Various methods for introducing polynucleotides into cells will be apparent to the skilled artisan.

5.6 Methods of Generating Engineered Transaminase Polypeptides

In some embodiments, to make the improved polynucleotides and polypeptides of the present disclosure, the naturally-occurring transaminase enzyme that catalyzes the transamination reaction is obtained (or derived) from *Arthrobacter* sp. KNK168. In some embodiments, the parent polynucleotide sequence is codon optimized to enhance expression of the transaminase in a specified host cell. The parental polynucleotide sequence encoding the wild-type polypeptide of *Arthrobacter* sp. KNK168 has been described (see e.g., Iwasaki et al., Appl. Microbiol. Biotechnol., 2006, 69: 499-505). Preparations of engineered transaminases based on this parental sequence are also described in US patent publication no. 2010/0285541A1 and published International application WO2010/099501.

The engineered transaminases can be obtained by subjecting the polynucleotide encoding the naturally occurring transaminase to mutagenesis and/or directed evolution methods, as discussed above. An exemplary directed evolution technique is mutagenesis and/or DNA shuffling as described in Stemmer, 1994, Proc Natl Acad Sci USA 91:10747-10751; WO 95/22625; WO 97/0078; WO 97/35966; WO 98/27230; WO 00/42651; WO 01/75767 and U.S. Pat. No. 6,537,746. Other directed evolution procedures that can be used include, among others, staggered extension process (StEP), in vitro recombination (Zhao et al., 1998, Nat. Biotechnol. 16:258-261), mutagenic PCR (Caldwell et al., 1994, PCR Methods Appl. 3:S136-S140), and cassette mutagenesis (Black et al., 1996, Proc Natl Acad Sci USA 93:3525-3529). Mutagenesis and directed evolution techniques useful for the purposes herein are also described in e.g., Ling, et al., 1997, Anal. Biochem. 254(2):157-78; Dale et al., 1996, "Oligonucleotide-directed random mutagenesis using the phosphorothioate method," in Methods Mol. Biol. 57:369-74; Smith, 1985, Ann. Rev. Genet. 19:423-462; Botstein et al., 1985, Science 229:1193-1201; Carter, 1986, Biochem. J. 237:1-7; Kramer et al., 1984, Cell, 38:879-887; Wells et al., 1985, Gene 34:315-323; Minshull et al., 1999, Curr Opin Chem Biol 3:284-290; Christians et al., 1999, Nature Biotech 17:259-264; Crameri et al., 1998, Nature 391:288-291; Crameri et al., 1997, Nature Biotech 15:436-438; Zhang et al., 1997, Proc Natl Acad Sci USA 94:45-4-4509; Crameri et al., 1996, Nature Biotech 14:315-319; Stemmer, 1994, Nature 370:389-391; Stemmer, 1994, Proc Natl Acad Sci USA 91:10747-10751; PCT Publ. Nos. WO 95/22625, WO 97/0078, WO 97/35966, WO 98/27230, WO 00/42651, and WO 01/75767; and U.S. Pat. No. 6,537,746. All publications and patent are hereby incorporated by reference herein.

The clones obtained following mutagenesis treatment can be screened for engineered transaminases having a desired improved enzyme property. Measuring enzyme activity from the expression libraries can be performed using the standard biochemistry techniques, such as HPLC analysis following OPA derivatization of the product amine.

Where the improved enzyme property desired is thermostability, enzyme activity may be measured after subjecting the enzyme preparations to a defined temperature and measuring the amount of enzyme activity remaining after heat treatments. Clones containing a polynucleotide encoding a transaminase are then isolated, sequenced to identify the nucleotide sequence changes (if any), and used to express the enzyme in a host cell.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides of the disclosure can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources.

In some embodiments, the present disclosure also provides methods for preparing or manufacturing the engineered transamination polypeptides capable of converting compound 2 to compound 1 under suitable reaction conditions, wherein the methods comprise culturing a host cell capable of expressing a polynucleotide encoding the engineered polypeptide under culture conditions suitable for expression of the polypeptide. In some embodiments, the method for preparation of the polypeptide further comprises isolating the polypeptide. The engineered polypeptides can be expressed in appropriate cells (as described above), and isolated (or recovered) from the host cells and/or the culture medium using any one or more of the well known techniques used for protein purification, including, among others, lysozyme treatment, sonication, filtration, salting-out, ultra-centrifugation, and chromatography. Chromatographic techniques for isolation of the polypeptide include, among others, reverse phase chromatography high performance liquid chromatography, ion exchange chromatography, gel electrophoresis, and affinity chromatography. Conditions for purifying a particular engineered polypeptide will depend, in part, on factors such as net charge, hydrophobicity, hydrophilicity, molecular weight, molecular shape, etc., and will be apparent to those having skill in the art.

5.7 Methods of Using the Engineered Transaminase Enzymes and Compounds Prepared Therewith In another aspect, the engineered transaminase polypeptides disclosed herein can be used in a process for the conversion of the substrate compound 2, or structural analogs thereof, to the product of compound 1 or the corresponding structural analog. Subsequent cyclization of compound 1, either in situ under reaction conditions of the transaminase reaction or as a separate step produces the corresponding lactam, or lactam analog. Generally the structural analogs of compound 1 are encompassed within structural formula I,

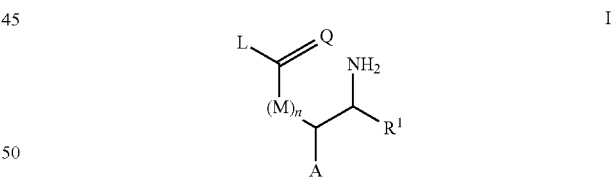

wherein
L is a leaving group;
A is an optionally substituted cycloalkyl, heterocycloalkyl, aryl, heteroaryl, fused aryl, or fused heteroaryl;
$R^1$ is H or an optionally substituted alkyl;
Q is O or S;
M is —$CR^aR^b$—, wherein each M is independent of the other and $R^a$ and $R^b$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and n is an integer from 0 to 4.

Accordingly, in some embodiments, a process for the preparation of a compound of formula I above, can comprise contacting a compound of formula II

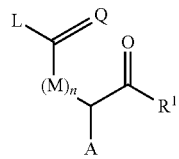

II where L, A, R$^1$, Q, M and n are defined above, with a transaminase polypeptide of the disclosure in presence of an amino donor under suitable reaction conditions.

The leaving group L can comprise any suitable group that can be replaced by the nucleophilic amino group. In some embodiments, L is selected from Cl, Br, —OR$^f$, —OC(O)R$^f$, —SR$^f$, and —OPO$_3$, wherein each R$^f$ is, independently of the others, selected from (C$_1$-C$_6$)alkyl or aryl. In some embodiments, L is —OR$^f$, wherein R$^f$ is selected from an optionally substituted methyl, ethyl, n-propyl, n-butyl, iso-butyl, sec-butyl, and tert-butyl.

In some embodiments, A is an optionally substituted aryl or heteroaryl. Exemplary aryl or heteroaryl groups can be selected from, among others, optionally substituted phenyl, pyridinyl, indolyl and napthyl.

When present, the substitutions on A can include any enzyme compatible group. In some embodiments, A can have one or more substitutions selected from H, —COOH, —OR$^g$, —SO$_2$, —SR$^h$, —NR$^i$R$^j$, —NO$_2$, —CN, halo, alkyl, cycloalkyl, heterocycloalkyl, aryl, and heteroaryl, wherein R$^g$, R$^h$, R$^i$ and R$^j$ are selected from H and (C$_1$-C$_6$)alkyl.

In some embodiments, R$^1$ is an optionally substituted (C$_1$-C$_6$)alkyl. Exemplary alkyls can be selected from optionally substituted methyl, ethyl, n-propyl, 2-propyl, n-butyl, and 2-butyl.

In some embodiments, R$^a$ and R$^b$ for M are selected from H and —NR$^d$R$^e$, where R$^d$ and R$^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group.

In the embodiments above where the substituent comprises an amine protecting group, the protecting group can be selected from tert-butyloxycarbonyl (Boc), 9-fluorenylmethyloxycarbonyl (Fmoc), trichloroethyl chloroformate (Troc), p-methoxybenzyl carbonyl (Moz), 3,4-dimethoxybenzyl (DMPM), p-methoxybenzyl (Pmb), tosyl (Ts) and carbobenzyloxy (Cbz). Other amine protecting groups are described in Wuts and Greene, "Greene's Protective Groups in Organic Synthesis," 4$^{th}$ Ed., Wiley Interscience (2006).

The number "n" of group M in formula II can be varied, particularly for preparation of substituted lactam compounds, as further described below. The value of n can be from 0 to 4, in particular 1, 2, 3 or 4, and more particularly 2 or 3.

In some embodiments of the process, the compound of formula II can comprise the compound of formula IIa,

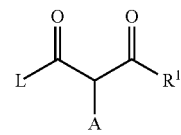

IIa

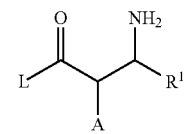

Ia where L, A, and R$^1$ are as defined above, to produce the compound of formula Ia.

In some embodiments of the process, the compound of formula II comprises the compound of formula IIb

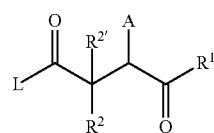

IIb

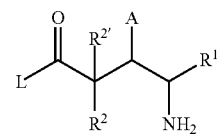

Ib where

L, A, and R$^1$ are as defined above, and

R$^2$ and R$^{2'}$ are selected from H, halo, —OR$^c$, —SR$^c$, —CN, —NO$_2$, —NR$^d$R$^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein R$^c$ is selected from H, alkyl, cycloalkyl, heterocycloalkyl, aryl, and heteroaryl, and R$^d$ and R$^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

to produce the compound of formula Ib.

In some embodiments of the process, the compound of formula II comprises the compound of formula IIc,

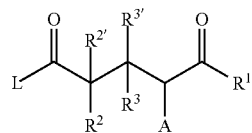

IIc

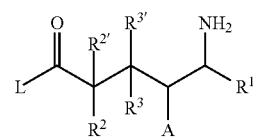

Ic wherein,

L, A, and R¹ are as defined above;

R², R²' R³ and R³' are selected from H, halo, —OR$^c$, —SR$^c$, —CN, —NO$_2$, —NR$^d$R$^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein R$^c$ is selected from H, alkyl, cycloalkyl, heterocycloalkyl, aryl, and heteroaryl, and R$^d$ and R$^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

to produce the compound of formula Ic.

In some embodiments of the process, the compound of formula II comprises the compound of formula IId,

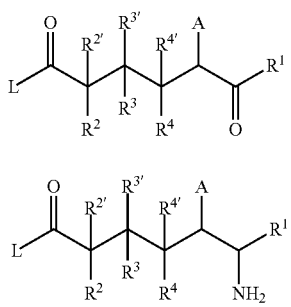

IId

Id wherein,

L, A, and R¹ are as defined above;

R², R²', R³, R³', R⁴ and R⁴' are selected from H, halo, —OR$^c$, —SR$^c$, —CN, —NO$_2$, —NR$^d$R$^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein R$^c$ is selected from H, alkyl, cycloalkyl, heterocycloalkyl, aryl, and heteroaryl, and R$^d$ and R$^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

to produce the compound of formula Id.

In some embodiments of the process, the compound of formula II comprises the compound of formula IIc1,

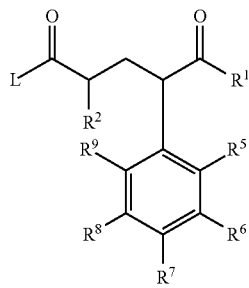

IIc1

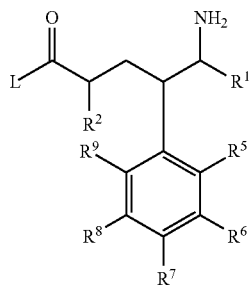

Ic1 wherein

L and R¹ are as defined above;

R² is selected from H, halo, —OR$^c$, —SR$^c$, —CN, —NO$_2$, —NR$^d$R$^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein R$^c$ is selected from H, alkyl, cycloalkyl, heterocycloalkyl, aryl, and heteroaryl, and R$^d$ and R$^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and R⁵, R⁶, R⁷, R⁸, and R⁹ are selected from H, —COOH, —OR$^g$, —SO$_2$, —SR$^h$, —NR$^i$R$^j$, —NO$_2$, —CN, halo, alkyl, cycloalkyl, heterocycloalkyl, aryl, and heteroaryl, wherein R$^g$, R$^h$, R$^i$ and R$^j$ are selected from H and (C$_1$-C$_6$)alkyl, to produce the compound of formula Ic1.

In some embodiments of the process, the compound of formula II comprises the compound of formula 2p,

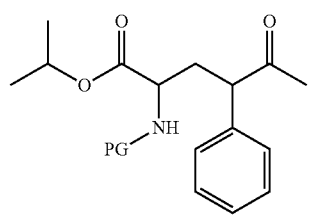

2p

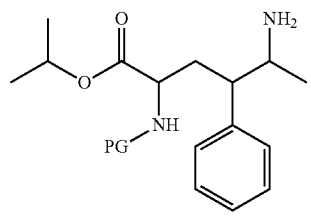

1p wherein PG is a protecting group, to produce the compound of formula 1p.

In some embodiments of the process, the compound of formula II comprises the compound of formula 2q,

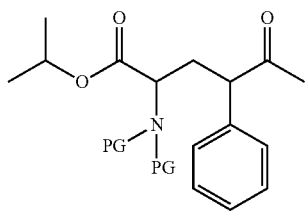

2q

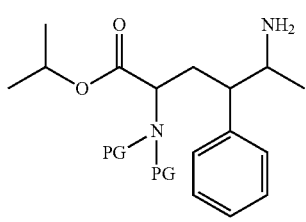

1q wherein the compound has two protecting groups, PG, to produce the compound of formula 1q.

In some embodiments of the process, the compound of formula II comprises the compound of formula IId1,

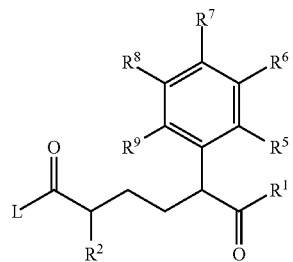

IId1

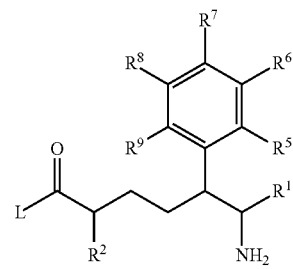

Id1 wherein,

L and $R^1$ are as defined above;

$R^2$ is selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and $R^5$, $R^6$, $R^7$, $R^8$, and $R^9$ are selected from H, —COOH, —$OR^g$, —$SO_2$, —$SR^h$, —$NR^iR^j$, —$NO_2$, —CN, halo, alkyl, cycloalkyl, heterocycloalkyl, aryl, and heteroaryl, wherein $R^g$, $R^h$, $R^i$ and $R^j$ are selected from H and ($C_1$-$C_6$)alkyl, to produce the compound of formula Id1.

In some embodiments of the process, the compound of formula II comprises the compound of formula IId2,

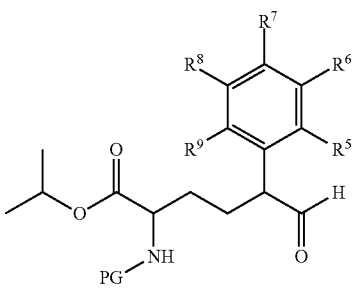

IId2

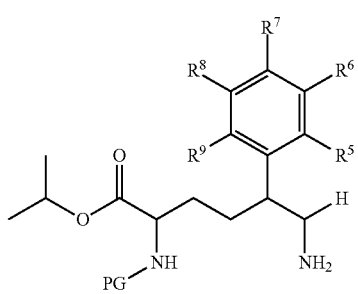

Id2 wherein, $R^5$, $R^6$, $R^7$, $R^8$, and $R^9$ are selected from H, —COOH, —$OR^g$, —$SO_2$, —$SR^h$, —$NR^iR^j$, —$NO_2$, —CN, halo, alkyl, cycloalkyl, heterocycloalkyl, aryl, and heteroaryl, wherein $R^g$, $R^h$, $R^i$ and $R^j$ are selected from H and ($C_1$-$C_6$)alkyl, and PG is a protecting group, to produce the compound of formula Id2.

As noted herein, some embodiments of the transaminase polypeptides are capable of converting compound 2 to compounds 1d and 1a in a diastereomeric ratio of greater than 8:1 over compound 1b and compound 1c. As will be understood by the skilled artisan, these transaminase polypeptides can be used to produce structural analogs in diastereomeric excess. Accordingly, in some embodiments, the disclosed polypeptides can be used in a process for preparing compound 1d1 and compound 1a1,

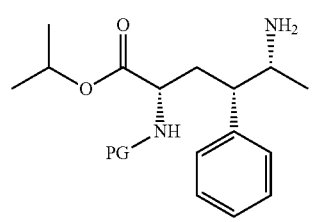

1d1

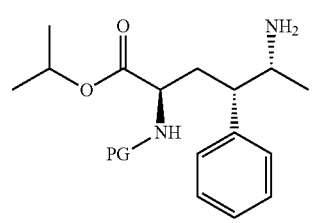

1a1

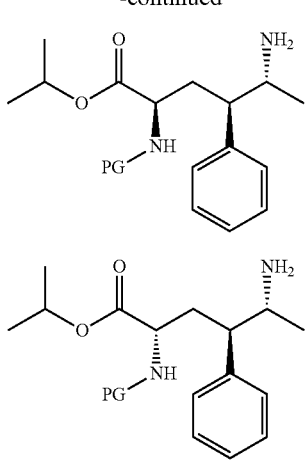

1b1

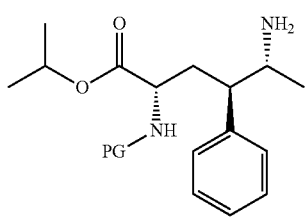

1c1 wherein PG is a protecting group, in diastereomeric ratio greater than 8:1 over compound 1b1 and compound 1c1, where the process comprises contacting compound 2p

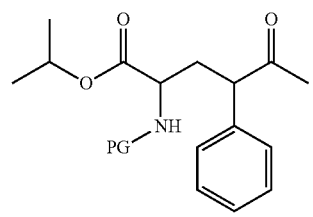

2p with a transaminase polypeptide described herein with the indicated level of diastereoselectivity for compound 1d1 and compound 1a1 in presence of an amino donor under suitable reaction conditions. As described herein, exemplary polypeptides include SEQ ID NO: 6, 10, 12, 14, 16, 18, 20, 22, 24, 26, 30, 32, 34, 36, 38, 40, 42, 44, 46, 48, 50, 52, 54, 56, 58, 60, 62, 64, 66, 68, 70, 72, 74, 76, 78, 80, 82, 84, and the polypeptides of even numbered sequence identifiers SEQ ID NO: 306-854.

Further, in some embodiments, the transaminase polypeptides can be used in a process for preparing compound 1d1 in diastereomeric excess of compound 1a1, where the process comprises contacting the compound of formula 2p with a polypeptide described herein with the indicated level of diastereoselectivity for compound 1d1 over compound 1a1 in the presence of an amino donor under suitable reaction conditions. Exemplary polypeptides having diastereoselectivity for compound 1d1 over compound 1a1 include SEQ ID NO: 6, 14, 22, 24 and 28.

In some embodiments, the transaminase polypeptides can be used in a process for preparing compound 1a1 in diastereomeric excess of compound 1d1, where the process comprises comprising contacting the compound of formula 2p with a transaminase polypeptide described herein with diastereoselectivity for compound 1a1 over compound 1d1 in the presence of an amino donor under suitable reaction conditions. Exemplary transaminase polypeptides with diastereoselectivity for compound 1a1 over compound 1d1 include SEQ ID NO: 16, 18, 20, 26, 34, 42, 46, 56, 58, 60, 62, 64, 68, 70, 72, 74, 76, 78, 80, 82, 84, and the polypeptides of even numbered sequence identifiers SEQ ID NO: 306-854.

As described herein, and illustrated in the Examples, the present disclosure contemplates ranges of suitable reaction conditions that can be used in the processes herein, including but not limited to ranges of pH, temperature, buffer, solvent system, substrate loading, mixture of substrate compound stereoisomers, polypeptide loading, cofactor loading, pressure, and reaction time. Further suitable reaction conditions for carrying out the process for biocatalytic conversion of substrate compounds to product compounds using an engineered transaminase polypeptide described herein can be readily optimized by routine experimentation that includes, but is not limited to, contacting the engineered transaminase polypeptide and substrate compound under experimental reaction conditions of concentration, pH, temperature, solvent conditions, and detecting the product compound, for example, using the methods described in the Examples provided herein.

As described above, the engineered transaminase polypeptides for use in the processes of the present disclosure generally comprise an amino acid sequence having at least 80%, 85%, 86%, 87%, 88%, 89%, 90%, 91%, 92%, 93%, 94%, 95%, 96%, 97%, 98%, or 99% identity to a reference amino acid sequence selected from any one of the even-numbered sequences of SEQ ID NO: 6-854, and (a) one or more amino acid residue differences as compared to SEQ ID NO:4 at residue positions selected from X6, X10, X12, X13, X17, X21, X22, X29, X31, X34, X43, X47, X64, X66, X68, X72, X80, X84, X85, X88, X97, X103, X115, X127, X128, X131, X134, X139, X140, X142, X143, X159, X161, X168, X176, X179, X185, X190, X191, X192, X196, X208, X210, X227, X231, X233, X234, X241, X265, X266, X270, X274, X295, X300, X305, X308, X309, X311, X312, X316, X319, X320, X323, X324, X325, and X327, or (b) one or more amino acid residue differences as compared to SEQ ID NO:4 selected from: X52H; X54A; X54L; X56D; X56E; X61G; X61W; X62A; X62L; X62N; X62S; X117V; X122F; X122W; X122Y; X124K; X124M; X124S; X124W; X126C; X126I; X136K; X136L; X136M; X150L; X152A; X152F; X152R; X152W; X155I; X155L; X199L; X199V; X209F; X209M; X209Q; X209V; X215H; X215L; X223S; X223T; X223V; X269L; X273H; X282I; X282L; X282V; X284A; X284P; X284S; X284T; X284V; and X296D. In some embodiments, the transaminase polypeptide has the percent identity described above and one or more residue differences as compared to SEQ ID NO:4 selected from: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X10L; X12H; X13A, X13F; X17L; X18I; X21L; X22A, X22H; X25A; X27L, X27H, X27P; X28N; X29N, X29T; X30F, X30G; X31H, X31R; X34V; X42G; X43S; X47R; X48G, X48R, X48S, X48W; X49I, X49P; X50S; X52H; X54A, X54L, X54M, X54P, X54R; X56D, X56E, X56W; X61G; X61W; X62A, X62L, X62N, X62S; X64C; X66A, X66S; X68I; X69A, X69G, X69T; X72A; X80Q; X84T; X85L; X88W; X97P; X102T, X102W; X103G, X103N; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X134G, X134L, X134S, X134V, X134Y, X134W; X136F, X136K, X136L, X136M, X136Y; X139E; X140A, X140K, X140M, X140T; X142M; X143V; X146R; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M; X165N; X168R; X176C; X179K; X185A; X190M; X191A, X191G, X191S; X192A, X192G, X192H, X192K, X192N, X192Q, X192R, X192S; X196L, X196V; X199L, X199V; X208K; X209F, X209M, X209Q, X209V; X210G, X210S; X215F, X215H, X215L; X223A, X223S, X223T, X223V; X227I; X231T; X233D; X234L; X241R; X265Y, X265W; X266N; X267V; X269L, X269T; X270R; X273D, X273H, X273M, X273R, X273V; X274F, X274L, X274R, X274T; X282I, X282L, X282T, X282V; X284A, X284P, X284S, X284T, X284V; X295N, X295S; X296D, X296R, X296S, X296W; X300G, X300L; X305Q; X308A; X309W, X309L; X311T; X312C, X312M; X316L, X316R; X319R, X319T, X319Y; X320G, X320Q; X323C, X323E, X323R; X324Q; X325M, X325P, X325Q, X325V; X327L; and X329P.

The improved activity and/or stereoselectivity of the engineered transaminase polypeptides disclosed herein in the conversion of compound 2 to compound 1, including various diastereomers and analogs thereof provides for processes wherein higher percentage conversion can be achieved with lower concentrations of the engineered polypeptide and also reduces the amount of residual protein that may need to be removed in subsequent steps for purification of product compound (e.g., compound 1) and, as further described herein, purification of the corresponding cyclic compounds. In some embodiments of the process, the suitable reaction conditions comprise an engineered polypeptide concentration of about 0.1 to about 40 g/L, about 0.5 to about 20 g/L, about 1.0 to about 10 g/L, about 2 to about 5 g/L, about 40 g/L or less, about 20 g/L or less, about 15 g/L or less, about 10 g/L or less, about 5 g/L or less, about 3 g/L or less, about 2 g/L or less, about 1.5 g/L or less, about 1.0 g/L or less, about 0.75 g/L or less.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments of the method, the suitable reaction conditions comprise a substrate compound loading of at least about 0.5 to about 200 g/L, 1 to about 200 g/L, 5 to about 150 g/L, about 10 to about 100 g/L, or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound 2, however it also contemplated that the equivalent molar amounts of various hydrates and salts of compound 2 also can be used in the process. In addition, substrates compounds covered by formulas, IIa, IIb, IIc, IId, IIc1, IIc2, IId1, IId2, and 2p can also be used in appropriate amounts, in light of the amounts used for compound 2.

In the processes describes herein, the transaminase polypeptide uses an amino donor to form the product compounds. In some embodiments, the amino donor in the reaction condition comprises a compound selected from isopropylamine (also referred to herein as "IPM"), putrescine, L-lysine, α-phenethylamine, D-alanine, L-alanine, or D,L-alanine, or D,L-ornithine. In some embodiments, the amino donor is selected from the group consisting of IPM, putrescine, L-lysine, D- or L-alanine. In some embodiments, the amino donor is IPM. In some embodiments, the suitable reaction conditions comprise the amino donor, in particular IPM, present at a concentration of at least about 0.1 to about 3.0 M, 0.2 to about 2.5 M, about 0.5 to about 2 M or about 1 to about 2 M. In some embodiments, the amino donor is present at a concentration of about 0.1, 0.2, 0.3, 0.4, 0.5, 0.6, 0.7, 0.8, 1, 1.5, 2, 2.5 or 3 M.

Suitable reaction conditions for the processes also typically comprise the presence of a cofactor in the reaction mixture. Because the engineered transaminases typically use members of the vitamin $B_6$ family, the reaction condition can comprise a cofactor selected from pyridoxal-5'-phosphate (also known as pyridoxal-phosphate, PLP, P5P), pyridoxine (PN), pyridoxal (PL), pyridoxamine (PM), and their phosphorylated counterparts; pyridoxine phosphate (PNP), and pyridoxamine phosphate (PMP). In some embodiments, the suitable reaction conditions can comprise the presence of a cofactor selected from PLP, PN, PL, PM, PNP, and PMP, at a concentration of about 0.1 g/L to about 10 g/L, about 0.2 g/L to about 5 g/L, about 0.5 g/L to about 2.5 g/L. In some embodiments, the cofactor is PLP. Accordingly, in some embodiments, the suitable reaction conditions can comprise the presence of the cofactor, PLP, at a concentration of about 0.1 g/L to about 10 g/L, about 0.2 g/L to about 5 g/L, about 0.5 g/L to about 2.5 g/L. In some embodiments, the reaction conditions comprise a PLP concentration of about 10 g/L or less, about 5 g/L or less, about 2.5 g/L or less, about 1.0 g/L or less, about 0.5 g/L or less, or about 0.2 g/L or less.

In some embodiments of the process (e.g., where whole cells or lysates are used), the cofactor is present naturally in the cell extract and does not need to be supplemented. In some embodiments of the process (e.g., using partially purified, or purified transaminase enzyme), the process can further comprise a step of adding cofactor to the enzyme reaction mixture. In some embodiments, the cofactor is added either at the beginning of the reaction and/or additional cofactor is added during the reaction.

During the course of the transamination reactions, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, carbonate, phosphate, triethanolamine buffer, and the like. In some embodiments, the buffer is borate. In some embodiments of the process, the suitable reaction conditions comprise a buffer solution of borate, where the borate concentration is from about 0.01 to about 0.4 M, 0.05 to about 0.4 M, 0.1 to about 0.3 M, or about 0.1 to about 0.2 M. In some embodiments, the reaction condition comprises a borate concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. As noted above, the desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH of about 8 to about 12.5, a pH of about 8 to about 12, a pH of about 9.0 to about 11.5, or a pH of about 9.5 to about 11.0. In some embodiments, the reaction conditions comprise a solution pH of about 8, 8.5, 9, 9.5, 10, 10.5, 11, 11.5, 12 or 12.5.

In the embodiments of the processes herein, a suitable temperature can be used for the reaction conditions, for example, taking into consideration the increase in reaction rate at higher temperatures, the activity of the enzyme for sufficient duration of the reaction, and as further described below, increase rate of epimerization of the substrate diastereomers (for purposes of dynamic kinetic resolution). For example, the engineered polypeptides of the present disclosure have increased stability relative to naturally occurring transaminase polypeptide e.g., the wild type polypeptide of SEQ ID NO: 2, which allow the engineered polypeptides to be used at higher temperatures for increased conversion rates and improved substrate solubility characteristics for the reaction. Accordingly, in some embodiments, the suitable reaction conditions comprise a temperature of about 10° C. to about 70° C., about 10° C. to about 65° C., about 15° C. to about 60° C., about 20° C. to about 60° C., about 20° C. to about 55° C., about 30° C. to about 55° C., or about 40° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., or 70° C. In some embodiments, the temperature during the enzymatic reaction can be maintained at a temperature throughout the course of the reaction. In some embodiments, the temperature during the enzymatic reaction can be adjusted over a temperature profile during the course of the reaction.

In some embodiments of the process, the suitable reaction conditions can further comprise the presence of the reduced cofactor, nicotinamide adenine dinucleotide (NADH), which can act to limit the inactivation of the transaminase enzyme (see e.g., van Ophem et al., 1998, Biochemistry 37(9):2879-88). In such embodiments where NADH is present, a cofactor regeneration system, such as glucose dehydrogenase (GDH) and glucose or formate dehydrogenase and formate can be used to regenerate the NADH in the reaction medium.

The processes using the engineered transaminases are generally carried out in a solvent. Suitable solvents include water, aqueous buffer solutions, organic solvents, and/or co-solvent systems, which generally comprise aqueous solvents and organic solvents. The aqueous solvent (water or aqueous co-solvent system) may be pH-buffered or unbuffered. In some embodiments, the processes using the engineered transaminase polypeptides are generally carried out in an aqueous co-solvent system comprising an organic solvent (e.g., ethanol, isopropanol (IPA), dimethyl sulfoxide (DMSO), ethyl acetate, butyl acetate, 1-octanol, heptane, octane, methyl t-butyl ether (MTBE), toluene, and the like), ionic liquids (e.g., 1-ethyl 4-methylimidazolium tetrafluoroborate, 1-butyl-3-methylimidazolium tetrafluoroborate, 1-butyl-3-methylimidazolium hexafluorophosphate, and the like). The organic solvent component of an aqueous co-solvent system may be miscible with the aqueous component, providing a single liquid phase, or may be partly miscible or immiscible with the aqueous component, providing two liquid phases. Exemplary aqueous co-solvent systems comprises water and one or more organic solvent. In general, an organic solvent component of an aqueous co-solvent system is selected such that it does not completely inactivate the transaminase enzyme. Appropriate co-solvent systems can be readily identified by measuring the enzymatic activity of the specified engineered transaminase enzyme with a defined substrate of interest in the candidate solvent system, utilizing an enzyme activity assay, such as those described herein. In some embodiments of the process, the suitable reaction conditions comprise an aqueous co-solvent comprising DMSO at a concentration of about 1% to about 80% (v/v), about 1 to about 70% (v/v), about 2% to about 60% (v/v), about 5% to about 40% (v/v), 10% to about 40% (v/v), 10% to about 30% (v/v), or about 10% to about 20% (v/v). In some embodiments of the process, the suitable reaction conditions comprise an aqueous co-solvent comprising DMSO at a concentration of at least about 1%, 5%, 10%, 15%, 20%, 25%, 30%, 35%, 40%, 45%, 50%, 55%, 60%, 65%, 70%, 75%, or 80% (v/v).

Generally, the method of converting the various substrate compounds to their corresponding product compounds using the engineering transaminase polypeptides can be carried out wherein the suitable reaction conditions comprise the substrate compound, including various mixtures of stereoisomers of substrate compound. Accordingly, in some embodiments, the substrate compound 2 can comprise a mixture of one or more stereoisomers 2a, 2a', 2b, 2b', 2c, 2c', 2d and 2d'. As noted herein, under certain conditions the substrate of compound 2 is capable of undergoing an epimerization reaction between its various stereoisomers that provides an equilibrium between them (see Scheme 2 above). Because the engineered transaminase polypeptides disclosed herein can exhibit high stereoselectivity for compound 1d, and/or compound 1d and compound 1a, this equilibrium between the various stereoisomers provides for the ability to carry out a dynamic kinetic resolution (DKR) of the stereoisomers, whereby the amount of product compound 1d, and/or compound 1d and compound 1a formed is greater than the amount of corresponding stereomeric substrate, i.e., compound 2d and compound 2a present at the beginning of the reaction. Because the DKR reaction is favored at conditions of at least pH 9 and 45° C., the suitable conditions in some embodiments of the process can further comprise a solution pH of at least pH 9.5, at least pH 10.0, at least pH 10.5, at least pH 11.0, at least pH 11.5, and a solution temperature of at least 45° C., at least 50° C., at least 55° C., at least 60° C., or at least 65° C.

The suitable reaction conditions can comprise a combination of reaction parameters that provide for the biocatalytic conversion of the substrate compounds to its corresponding product compounds. Accordingly, in some embodiments of the process, the combination of reaction parameters comprises: (a) substrate loading of about 10 to 100 g/L of substrate compound; (b) transaminase polypeptide concentration of about 1 to 40 g/L; (c) IPM concentration of about 0.1 to 10 M; (d) PLP cofactor concentration of about 0.1 to 1 g/L; (e) pH of about 8.5 to 11; and (f) temperature of about 30 to 60° C.

In some embodiments, the combination of reaction parameters comprises: (a) about 5 g/L substrate compound, (b) about 15 g/L or less of transaminase polypeptide, (c) about 20% (v/v) dimethylsulfoxide (DMSO), (d) about 1 M isopropylamine (IPM), (e) about 1 g/L pyridoxal phosphate (PLP), (f) about 0.2 M borate, (g) about pH 10.5, and (h) about 45° C.

In some embodiments, the combination of reaction parameters comprises: (a) about 5 g/L substrate compound, (b) about 5 g/L or less of transaminase polypeptide, (c) about 20% (v/v) dimethylsulfoxide (DMSO), (d) about 1 M isopropylamine (IPM), (e) about 1 g/L pyridoxal phosphate (PLP), (f) about 0.2 M borate, (g) about pH 10.5, and (h) about 45° C.

In some embodiments, the combination of reaction parameters comprises: (a) about 50 g/L substrate compound, (b) about 25 g/L or less of transaminase polypeptide, (c) about 50% (v/v) dimethylsulfoxide (DMSO), (d) about 1 M isopropylamine (IPM), (e) about 1 g/L pyridoxal phosphate (PLP), (f) about 0.2 M borate, (g) about pH 10.5, and (h) about 45° C.

Further exemplary reaction conditions include the assay conditions provided in Tables 2A, 2B, 2C, 2D, 2E, 2F, 2G, 2H, and 2I and Example 1.

In carrying out the transamination reactions described herein, the engineered transaminase polypeptide may be added to the reaction mixture in the partially purified or purified enzyme, whole cells transformed with gene(s) encoding the enzyme, and/or as cell extracts and/or lysates of such cells. Whole cells transformed with gene(s) encoding the engineered transaminase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (e.g., ammonium sulfate, polyethyleneimine, heat treatment or the like), followed by a desalting procedure (e.g., ultrafiltration, dialysis, and the like) prior to lyophilization. Any of the enzyme preparations may be stabilized by crosslinking using known crosslinking agents, such as, for example, glutaraldehyde, or immobilized to a solid phase material (e.g., resins, beads such as chitosan, Eupergit C, SEPABEADs, and the like).

In some embodiments of the transamination reactions described herein, the reaction is carried out under the suitable reaction conditions described herein, wherein the engineered transaminase polypeptide is immobilized to a solid support. Solid supports useful for immobilizing the engineered transaminases for carrying out the transamination reactions include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments where the engineered polypeptide can be expressed in the form of a secreted polypeptide, the culture medium containing the secreted polypeptides can be used in the process herein.

In some embodiments, solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at $-80°$ C. in small aliquots, then added to a pre-chilled lyophilization chamber, followed by the application of a vacuum.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, transaminase, and transaminase substrate may be added first to the solvent. For improved mixing efficiency when an aqueous co-solvent system is used, the transaminase, and cofactor may be added and mixed into the aqueous phase first. The organic phase may then be added and mixed in, followed by addition of the transaminase substrate. Alternatively, the transaminase substrate may be premixed in the organic phase, prior to addition to the aqueous phase.

In some embodiments, the process can further comprise a step of removal of the carbonyl by-product formed from the amino group donor when the amino group is transferred to the substrate compounds, e.g., IIa, IIb, IIc, IId, IIc1, IIc2, IId1, IId2, 2, and 2p. Such removal in situ can reduce the rate of the reverse reaction such that the forward reaction dominates and more substrate is then converted to product. Removal of the carbonyl by-product can be carried out in a number of ways. Where the amino group donor is an amino acid, such as alanine, the carbonyl by-product, a keto acid, can be removed by reaction with a peroxide (see, e.g., US Patent Publication 2008/0213845A1, incorporated herein by reference). Peroxides which can be used include, among others, hydrogen peroxide; peroxyacids (peracids) such as peracetic acid ($CH_3CO_3H$), trifluoroperacetic acid and metachloroperoxybenzoic acid; organic peroxides such as t-butyl peroxide (($CH_3)_3COOH$), or other selective oxidants such as tetrapropylammonium perruthenate, $MnO_2$, $KMnO_4$, ruthenium tetroxide and related compounds. Alternatively, pyruvate removal can be achieved via its reduction to lactate by employing lactate dehydrogenase to shift equilibrium to the product amine (see, e.g., Koszelewski et al., 2008, Adv Syn Catal. 350: 2761-2766). Pyruvate removal can also be achieved via its decarboxylation to carbon dioxide acetaldehyde by employing pyruvate decarboxylase (see, e.g., Höhne et al., 2008, Chem BioChem. 9: 363-365).

In some embodiments, where the choice of the amino donor results in a carbonyl by-product that has a vapor pressure higher than water (e.g., a low boiling co-product such as a volatile organic carbonyl compound), the carbonyl by-product can be removed by sparging the reaction solution with a non-reactive gas or by applying a vacuum to lower the reaction pressure and removing the carbonyl by-product present in the gas phase. A non-reactive gas is any gas that does not react with the reaction components. Various non-reactive gases include nitrogen and noble gases (e.g., inert gases). In some embodiments, the non-reactive gas is nitrogen gas. In some embodiments, the amino donor used in the process is isopropylamine (IPM), which forms the carbonyl by-product acetone upon transfer of the amino group to the amino group acceptor. The acetone can be removed by sparging with nitrogen gas or applying a vacuum to the reaction solution and removing the acetone from the gas phase by an acetone trap, such as a condenser or other cold trap. Alternatively, the acetone can be removed by reduction to isopropanol using a ketoreductase.

In some embodiments of the process where the carbonyl by-product is removed, the corresponding amino group donor can be added during the transamination reaction to replenish the amino group donor and/or maintain the pH of the reaction. Replenishing the amino group donor also shifts the equilibrium towards product formation, thereby increasing the conversion of substrate to product. Thus, in some embodiments where the amino group donor is IPM and the acetone product is removed in situ, the process can further comprise a step of adding IPM to the reaction solution to replenish the amino group donor lost during the acetone removal and to maintain the pH of the reaction (e.g., at about 8.5 to about pH 11.5).

Alternatively, in embodiments where an amino acid is used as amino group donor, the keto acid carbonyl by-product can be recycled back to the amino acid by reaction with ammonia and NADH using an appropriate amino acid dehydrogenase enzyme, thereby replenishing the amino group donor.

As described above, the product compounds formed using the transaminase polypeptides can be cyclized, in particular to prepare substituted lactam compounds. In some embodiments, the cyclization reaction can take place under the suitable reaction conditions of the transaminase reaction with the choice of certain leaving groups, in particular alkoxides. Alternatively, the cyclization reaction can occur under different conditions than the transaminase reaction, as further described below.

Accordingly, in some embodiments, a process for preparing the compound of formula III

III wherein,

A is an optionally substituted cycloalkyl, heterocycloalkyl, aryl, heteroaryl, fused aryl, or fused heteroaryl;

$R^1$ is H or an optionally substituted alkyl;

Q is O or S;

M is —$CR^aR^b$—, wherein each M is independent of the other and $R^a$ and $R^b$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and n is an integer from 0 to 4, comprises (a) carrying out any of the processes described above for preparing the compound of formula I,

I including specific embodiments thereof, and (b) cyclizing the compound of formula I.

In some embodiments, the compound of formula III comprises the compound of formula IIIa.

IIIa

Accordingly, the present disclosure provides a process for preparing the compound of formula IIIa wherein, A is an optionally substituted cycloalkyl, heterocycloalkyl, aryl, heteroaryl, fused aryl, or fused heteroaryl; and $R^1$ is H or an optionally substituted ($C_1$-$C_6$) alkyl, comprising (a) carrying out any of the processes above for producing compound of formula Ia, Ia and (b) cyclizing the compound of formula Ia.

In some embodiments, the compound of formula III comprises the compound of formula Mb.

IIIb

Accordingly, the present disclosure provides a process for preparing the compound of formula IIIb wherein, A is an optionally substituted cycloalkyl, heterocycloalkyl, aryl, heteroaryl, fused aryl, or fused heteroaryl;

$R^1$ is H or an optionally substituted($C_1$-$C_6$)alkyl; and $R^2$ and $R^{2'}$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

comprises (a) carrying out any of the process for preparing the compound of formula Ib, Ib and (b) cyclizing the compound of formula Ib.

In some embodiments, the compound of formula III comprises the compound of formula IIIc.

IIIc

Accordingly, the present disclosure provides a process for preparing the compound of formula IIIc wherein, A is an optionally substituted cycloalkyl, heterocycloalkyl, aryl, heteroaryl, fused aryl, or fused heteroaryl;

$R^1$ is H or an optionally substituted($C_1$-$C_6$) alkyl; and $R^2$, $R^{2'}$, $R^3$ and $R^{3'}$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

comprises (a) carrying out any of the processes above for preparing the compound of formula Ic,

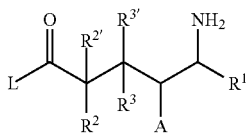

and (b) cyclizing the compound of formula Ic.

In some embodiments, the compound of formula III comprises the comprises the compound of formula IIId.

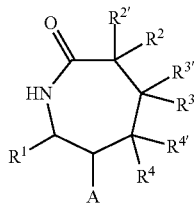

Accordingly, the present disclosure provides a process for preparing the compound of formula IIId wherein, A is an optionally substituted cycloalkyl, heterocycloalkyl, aryl, heteroaryl, fused aryl, or fused heteroaryl;

$R^1$ is H or an optionally substituted($C_1$-$C_6$) alkyl; and $R^2$, $R^{2'}$, $R^3$, $R^{3'}$, $R^4$ and $R^{4'}$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group;

comprises (a) carrying out the process described above for preparing the compound of formula Id,

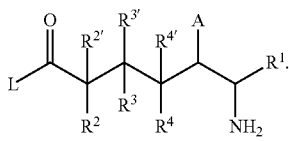

and (b) cyclizing the compound of formula Id.

In some embodiments of the process, the compound of formula III comprises the compound of formula IIIc1.

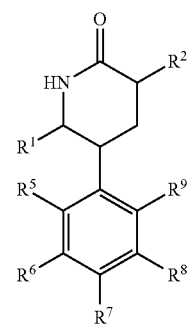

Accordingly, the present disclosure provides a process for preparing the compound of formula IIIc1 wherein, $R^1$ is H or an optionally substituted($C_1$-$C_6$) alkyl;

$R^2$ is selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and $R^5$, $R^6$, $R^7$, $R^8$, and $R^9$ are selected from H, —COOH, —$OR^g$, —$SO_2$, —$SR^h$, —$NR^iR^j$, —$NO_2$, —CN, halo, alkyl, cycloalkyl, heterocycloalkyl, aryl, and heteroaryl, wherein $R^g$, $R^h$, $R^i$ and $R^j$ are selected from H and ($C_1$-$C_6$)alkyl;

the process comprising (a) carrying out the process above for preparing the compound of formula Ic1,

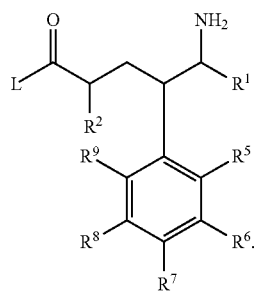

and (b) cyclizing the compound of formula Ic1. In some embodiments, L is an alkyloxy group and the cyclization step (b) occurs under the suitable reaction conditions of step (a).

In some embodiments of the process, the compound of formula III comprises compound 3p.

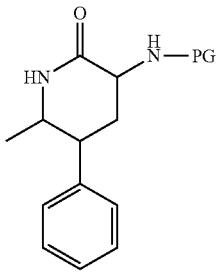

Accordingly, the present disclosure provides a process for preparing the compound 3p wherein PG is a protecting group, comprises (a) carrying out the process above for preparing compound 1p

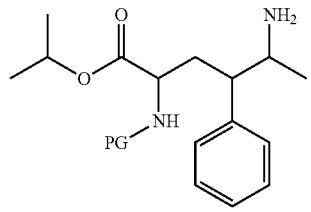

1p and (b) cyclizing the compound 1p. As discussed herein, an advantage of the foregoing process is that the cyclization step (b) occurs under the reaction conditions of step (a), allowed direct formation of compound 3 in the process of carrying out step (a).

In some embodiments, the compound for formula III comprises the compound of formula IIId1, and the process for preparing the compound of formula IIId1,

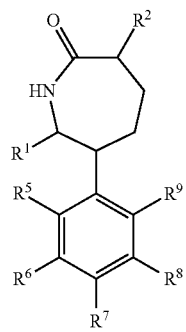

IIId1 wherein $R^1$ is H or an optionally substituted($C_1$-$C_6$) alkyl;

$R^2$ is selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and $R^5$, $R^6$, $R^7$, $R^8$, and $R^9$ are selected from H, —COOH, —$OR^g$, —$SO_2$, —$SR^h$, —$NR^iR^j$, —$NO_2$, —CN, halo, alkyl, cycloalkyl, heterocycloalkyl, aryl, and heteroaryl, wherein $R^g$, $R^h$, $R^i$ and $R^j$ are selected from H and ($C_1$-$C_6$)alkyl;

comprising (a) carrying out the process above for preparing the compound of formula Id1, and (b) cyclizing the compound of formula Id1.

In some embodiments of the process, the compound of formula IIId1 comprises the compound of formula compound IIId2,

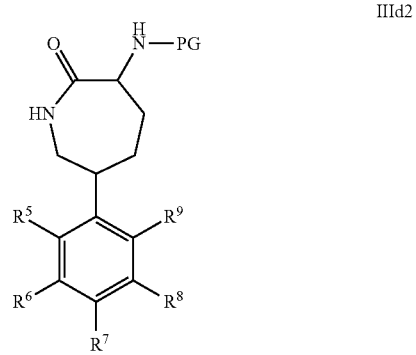

IIId2 wherein —PG is a protecting group, $R^5$, $R^6$, $R^7$, $R^8$, and $R^9$ are as defined above;

and the process comprises (a) carrying out the process above for preparing the compound of formula Id2, and (b) cyclizing the compound of formula Id2.

In some embodiments of the process, the compound of formula III comprises compound 3d1 and compound 3a1,

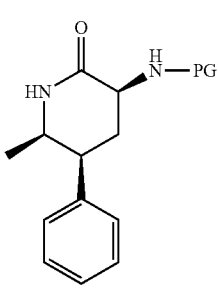

3d1

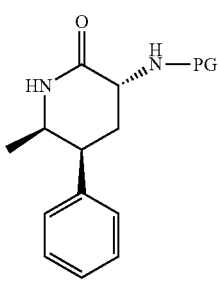

3a1

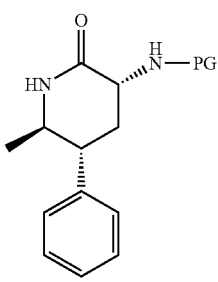

3b1

3c1

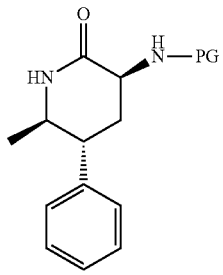

and compound 3d1 and compound 3a1 is produced in diastereomeric ratio greater than 8:1 over compound 3b1 and compound 3c1, wherein the process comprises (a) carrying out the process above for preparing compound 1d1 and compound 1a1 in diastereomeric ratio greater than 8:1 over compound 1b1 and compound 1c1, and (b) cyclizing the products of step (a).

In some embodiments of the process, the compound of formula III comprises compound 3d1, 3d1

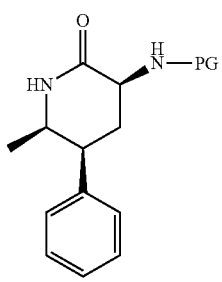

3a1

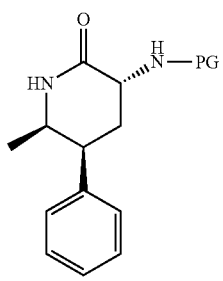

and compound 3d1 is produced in enantiomeric excess of compound 3a1, wherein the process comprises (a) carrying out the process herein for preparing compound 1d1 in enantiomeric excess of compound 1a1, and (b) cyclizing the products of step (a).

In some embodiments of the process, the compound of formula III comprises compound 3a1, 3a1

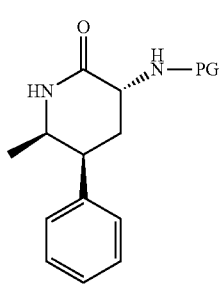

3d1

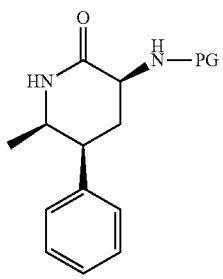

and compound 3a1 is produced in enantiomeric excess of compound 3d1, wherein the process comprising (a) carrying out the process herein for preparing compound 1a1 in enantiomeric excess of compound 1d1, and (b) cyclizing the products of step (a).

In some embodiments, the cyclization reaction can take place under the suitable reaction conditions used for the transaminase reactions, and can occur sequentially with the transaminase reaction, particularly where the leaving group L is an alkyloxy group. Alternatively, in some embodiments, a reaction condition different from the transamination reaction can be used. Conditions for cyclization are described in U.S. Pat. Nos. 6,150,535, 6,770,658, and 7,378,410, and PCT publication WO2010/150261. An exemplary cyclization reaction condition is in presence of NaOH and dimethylformamide. Cyclization can be carried without further isolation or following isolation of the aminated product compounds.

In some embodiments, it is also contemplated that the process comprising the biocatalytic conversion substrate compound to aminated compounds, and/or cyclized products using an engineered transaminase polypeptide can further comprise chemical steps of product work-up, extraction, isolation, purification, and/or crystallization, each of which can be carried out under a range of conditions.

Methods, techniques, and protocols for extracting, isolating, forming a salt of, purifying, and/or crystallizing aminated product compounds or cyclized compounds from biocatalytic reaction mixtures produced by the above disclosed processes are known to the ordinary artisan and/or accessed through routine experimentation. Additionally, illustrative methods are provided in the Examples below.

Various features and embodiments of the disclosure are illustrated in the following representative examples, which are intended to be illustrative, and not limiting.

6. EXAMPLES

Example 1

Synthesis, Optimization, and Screening of Engineered Transaminase Polypeptides

Gene Synthesis and Optimization:

A codon optimized polynucleotide sequence encoding the reported wild-type transaminase polypeptide from *Arthrobacter* sp. KNK168 of SEQ ID NO: 2 with a single amino acid change (I306V) was synthesized as described in WO/2010/099501 (incorporated herein by reference), cloned into a pCK110900 vector system (see e.g., US Patent Application Publication 2006/0195947A1) and subsequently expressed in *E. coli* W3110fhuA. The *E. coli* W3110 expresses the transaminase polypeptides as an intracellular protein under the control of the lac promoter. The polypeptide accumulates primarily as a soluble cytosolic, active enzyme. HTP assays used for primary screening were carried out using the cleared cell-lysate from expression of these *E. coli* W3110 cells (see below). Screening of various evolved transaminases for activity on substrate compound 2 identified the synthetic gene of SEQ ID NO: 3, which is disclosed in PCT application no. PCT/US11/46932, filed on Aug. 8, 2011 and has the following 24 amino acid differences relative to the naturally occurring transaminase of *Arthrobacter* sp. KNK168 (SEQ ID NO: 2): S8P; Y60F; L61Y; H62T; V65A; D81G; M94I; I96L; F122I; S124I; G136W; A169L; V199I; A209L; G215C; G217N; S223P; L269P; L273Y; T282S; A284G; P297S; I306V; and S321P.

The engineered gene (SEQ ID NO:3) encoding the transaminase polypeptide of SEQ ID NO: 4 was used as the starting backbone for further evolution to generate genes encoding the engineered transaminase polypeptides of the even-numbered sequence identifiers of SEQ ID NO: 6-854, each of which is capable of converting the substrate compound 2 to the product compound 1 with improved enzyme properties relative to it and/or the reference polypeptide of SEQ ID NO:4. Generating engineered derivatives of the gene sequence SEQ ID NO: 3 was carried out using the standard methods of directed evolution via iterative variant library generation by gene synthesis followed by screening and sequencing of hits.

HTP Activity Assay: *E. coli* cells expressing the engineered transaminase polypeptides were lysed by adding 150 µL or 300 µL of lysis buffer containing 0.2 M borate buffer, 0.5 g/L lysozyme, 0.4 g/L polymyxin B sulfate at pH 10.5, then shaking (at 250 rpm) for 1 h at room temperature. The general HTP activity assay conditions were: 5 g/L of compound 2, 40 or 100 µL clear cell lysate, 20% (v/v) DMSO, 1 M isopropylamine (IPM), 1 g/L PLP, 0.2 M borate, pH 10.5, 45° C. and 24 h. Specific lysis and assay conditions are noted in Tables 2A, 2B, 2E, 2F, 2G, and 2H.

SFP Assay: In addition to the HTP assay for primary screening, in some cases a secondary screening was carried out on a 2 mL scale using shake-flask powder (SFP) preparations of the engineered transaminase polypeptides (see Tables 2C and 2I). Shake flask powder (SFP) include approximately 30% total protein and accordingly provide a more purified preparation of an engineered enzyme as compared to the cell lysate used in HTP assays. For preparing SFPs, a single microbial colony of *E. coli* containing a plasmid encoding an engineered transaminase of interest was inoculated into 50 mL Luria Bertani broth containing 30 µg/ml chloramphenicol and 1% glucose. Cells were grown overnight (at least 16 hours) in an incubator at 30° C. with shaking at 250 rpm. The culture was diluted into 250 mL of 2×YT media (Difco) containing 30 µg/ml chloramphenicol, in a 1 liter flask to an optical density at 600 nm ($OD_{600}$) of 0.1 and allowed to grow at 30° C. Expression of the transaminase gene was induced by addition of isopropyl-β-D-thiogalactoside ("IPTG") to a final concentration of 1 mM when the $OD_{600}$ of the culture was 0.6 to 0.8. Incubation was then continued overnight (at least 16 hours). Cells were harvested by centrifugation (5000 rpm, 15 min, 4° C.) and the supernatant discarded. The cell pellet was resuspended with 10 mL of cold (4° C.) 50 mM potassium phosphate buffer pH 8.5, containing 100 µM pyridoxal 5' phosphate, and passed once through a one shot disrupter (Constant System Ltd) at 18-20 kpsi, while being maintained at 4° C. Cell debris was removed by centrifugation (9000 rpm, 30 minutes, 4° C.). The clear lysate supernatant was collected and stored at −80° C. Lyophilization of frozen clear lysate provides a dry shake-flask powder of crude transaminase polypeptide. Alternatively, the cell pellet (before or after washing) can be stored at 4° C. or −80° C.

The general SFP assay reaction conditions (specific conditions are noted in Tables 2C and 2I), were as follows: 5 g/L substrate mixture of compound 2, 5 or 15 g/L of the engineered transaminase polypeptide SFP, 1 g/L PLP, 1 M IPM, in an aqueous co-solvent solution of 0.2 M borate buffer, 20% (v/v) DMSO (as noted in Tables 2B, 2C, and 2D), pH 10.5, 45° C. reaction temperature and 24 h or 72 h reaction time, with stirring at 1200 rpm with a magnetic stirrer.

A stock solution (premix) was freshly prepared daily for every set of experiments. For a set of 15 experiments on 2 mL scale, the premix was prepared as follows: to 6 ml of 5M IPM in 0.2 M boric acid (non-pH adjusted) was added 3 mL PLP (10 g/L stock solution in sterile $H_2O$) followed by 4.5 ml DMSO and 12 mL of 0.2 M boric acid (non-pH adjusted). The pH of the premix solution then adjusted to 10.5 using concentrated HCl.

For each experiment, 1.7 mL of stock solution was added into a screw cap vial. The vial was tightly closed and heated to 45° C. upon magnetic stirring (800 to 1200 rpm). After 30 min, 200 µL of a solution of the enzyme power in 0.2 M borate, pH 10.5 was added to the reaction mixture at 45 C. The enzyme solution concentration was 10 times that of the desired concentration in reaction Immediately after the enzyme, 108 µL of a 92 g/L substrate stock solution in DMSO was added to start the reaction. The vial was tightly closed and the reaction allowed to continue with stirring (800 to 1200 rpm) at 45° C.

DSP Assay: DSP powders of the engineered transaminase polypeptides were prepared as a short batch fermentation followed by a fed batch process according to standard bioprocessing methods with 5 mM pyridoxine HCl added to feed and fermentor media. Briefly, transaminase polypeptide expression was induced by addition of IPTG to a final concentration of 1 mM. Following fermentation, the cells were harvested and resuspended in 100 mM triethanolamine-$H_2SO_4$ buffer with pH 7.5, then mechanically disrupted by transaminase polypeptide homogenization. The cell debris and nucleic acid was flocculated with polyethylenimine (PEI) and the suspension clarified by centrifugation. The resulting clear supernatant was concentrated using a tangential cross-flow ultrafiltration membrane to remove salts and water. The concentrated and partially purified enzyme concentrate was then dried in a lyophilizer to provide the DSP powder, which was packaged in containers (e.g., polyethylene).

For carrying out the DSP activity assays (see Tables 2D and 2I), a premix stock solution was freshly prepared by mixing 1 mL of 5M IPM in 0.2 M boric acid (non-pH adjusted) 0.5 mL PLP (10 g/L stock solution in sterile $H_2O$) followed by 2.5 mL of DMSO and 0.5 mL of 0.2 M boric acid (non-pH adjusted). The pH of the premix solution was then adjusted to 10.5 using concentrated HCl. The DSP powder was weighed in a glass vial and 0.5 mL of 0.2 M boric acid, pH 10.5 was added. The premix stock solution (4.5 mL) was then added and the mixture was heated to the desired reaction temperature (55° C.) upon stirring (800 to 1200 rpm). Once the desired temperature was reached, 250 mg of the substrate compound was added as a powder to start the reaction. The vial was tightly closed and the reaction monitored by HPLC as described.

HPLC Analysis of Activity Assay Samples: After running the HTP, SFP or DSP assays as described above, samples from quenched assay reaction solutions were analyzed using reverse phase HPLC to determine the conversion of compound 2 to the various stereomeric forms of compound 1 (i.e., compounds 1a, 1b, 1c and 1d).

Analysis of HTP activity assays in 96-well plates was carried out by reverse phase HPLC using a Chiralpak IA SFC column. Plates were removed from the incubator after overnight reaction and transferred into a 65-70° C. incubator. The reaction plates were heated for 1 hour without shaking. MeCN (200 μL) was then added to the plate to quench the reaction. The plates were shaken and centrifuged, and 100 μL of the clear supernatant transferred into a 96 round bottom HPLC plate containing 100 μL of MeCN in each well. Samples were analyzed by HPLC using the parameters shown below in Table 3.

TABLE 3

| Reverse phase HPLC on Chiralpak IA SFC column | |
|---|---|
| Column: | Chiralpak IA SFC column (4.6 × 50 mm, 5 μm) |
| Flow rate: | 2.5 mL/min |
| Column temp: | 40° C. |
| Mobile Phase Solvent: | 55% MeCN |
|  | 45% (10 mM Ammonium Acetate) |
| Run time: | 1.6 min |
| Detector wavelength: | 210 nm |
| Retention times: - | |
| Substrate: compound 2 - 0.57 min. | |
| Products: compound 1c - 0.82 min; compound 1c and 1b - 0.90 min; compound 1d - 1.43 min. | |

Analysis of the SFP and DSP activity assay samples were carried using reverse phase HPLC on a Kromasil 3-CelluCoat RP (4.6×150 mm). Samples were prepared by removing 20 μL aliquot of the reaction mixture and adding it to 60 μL of acetonitrile (ACN) in a shallow well plate. Plates were centrifuged at 4000 rpm for 10 min, and an aliquot of the supernatant used for analysis. HPLC analysis was carried according to the parameters shown below in Table 4.

TABLE 4

| Reverse phase HPLC on Phenomenex Kromasil 3-Cellucoat RP column | | | |
|---|---|---|---|
| Column: | Kromasil 3-CelluCoat RP (4.6 × 150 mm, 3 μm) with OD-RH guard column | | |
| Flow rate: | 1 mL/min | | |
| Column temp: | 25° C. | | |
| Mobile Phase Solvent A: | 2 mM ammonium formate, pH 3.5 with formic acid; | | |
| Solvent B: | ACN | | |
| Solvent program: | | | |
| Step | Time | % Solvent A | % Solvent B |
| 1 | 0 | 60 | 40 |
| 2 | 8 | 45 | 55 |
| 3 | 8.5 | 45 | 55 |
| 4 | 9 | 60 | 40 |
| 5 | 10 | 60 | 40 |
| Run time: | 10 min | | |
| Post time: | 1 min | | |
| Detector wavelength: | 210 nm | | |
| Retention times: - | | | |
| Products: compound 1a - 4.5 min; compound 1b - 4.9 min; compound 1c - 5.3 min; compound 1d - 5.8 min. | | | |
| Substrate: compound 2a - 7.8 min; compound 2b - 8.2 min; compound 2c - 8.6 min; compound 2d - 9.2 min. | | | |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (854 sequences)

SEQ ID NO: 1 - DNA, 990 bp, Arthrobacter sp. KNK168
atggcattcagcgccgatacctccgagatcgtctacacgcacgacaccggcctcgactacatcacttatagcgactacgaactcgatcctgctaacccgctcgcgggaggtgcggcatggatcgagggtgcattcgtgccgccgtcggaggcgcggatctcgatcttcgatcagggttacctccactcggacgtcacctacacggtcttccacgtctggaacggaaatgcattccgcctcgacgaccacatcgaacgcctcttctccaacgcggagtcgatgcgcatcatccctccgctcacacaggacgaagtgaaggagattgcgctcgaactcgtcgcgaagaccgaattgcgtgaggccttcgtgtccgtgtcgattacccgcggttacagctcgactccgggcgagcgcgacatcacgaagcaccgcccgcaggtgtacatgtatgccgtcccatatcagtggatcgtgccgtttgaccgaattcgcgacggcgtgcacgccatggtcgcacagagcgtgcgccgaaccccgcgcagctcgatcgaccctcaggtcaagaacttccagtggggggatctgatccgtgcggttcaagagacgcacgaccgcgggttcgaggctccccttctgctcgacggcgatggactgcttgccgagggctcggggttcaacgtcgtcgtgatcaaggacggcgtcgtgcgcagcccgggtcgagcggcgctccccggcattacgcggaagaccgtgctcgagatcgccgaatcgctcggacacgaggcgattctcgccgacatcacgctcgctgaactgctcgacgccgacgaagtgctcggctgcacgactgcgggcggagtgtggccattcgtcagcgtggacggcaaccccatctcggacggggttcccggccccatcacccagtcgatcatccgtcgttactgggagctgaatgtcgagagctcgtcgttgcttacgcctgtgcagtac

SEQ ID NO: 2 - protein, 330 aa, Arthrobacter sp. KNK168
MAFSADTSEIVYTHDTGLDYITYSDYELDPANPLAGGAAWIEGAFVPPSEARISIFDQGYLHSDVTYTVFHVWNGNAFRLDDHIERLFSNAESMRIIPPLTQDEVKEIALELVAKTELREAFVSVSITRGYSSTPGERDITKHRPQVYMYAVPYQWIVPFDRIRDGVHAMVAQSVRRTPRSSIDPQVKNFQWGDLIRAVQETHDRGFEAPLLLDGDGLLAEGSGFNVVVIKDGVVRSPGRAALPGITRKTVLEIAESLGHEAILADITLAELLDADEVLGCTTAGGVWPFVSVDGNPISDGVPGPITQSIIRRYWELNVESSSLLTPVQY

SEQ ID NO: 3 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 4 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 5 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttataattctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 6 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYNSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 7 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccacgttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 8 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 9 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgcccagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccctggtacagtac

SEQ ID NO: 10 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTLVQY

SEQ ID NO: 11 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttgctatcacccgtggttactcttctaccccatgggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 12 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVAITRGYSSTPWERDITKHRPQVYMYAAPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 13 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 14 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPLERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 15 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 16 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 17 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagaatggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 18 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQNGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 19 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 20 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 21 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgtgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 22 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 23 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctggcggtgttccgggtccggttacccagtctatcatccgtcgttactgggaactgaacgttgaaccttcttctctgctgaccccggtacagtac

SEQ ID NO: 24 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFEMPLLLDCDNLLAEGPGFNVVVIKDGVVRSPGRAALPGITRKTVLEIAESLGHEAILADITPAELYDADEVLGCSTGGGVWPFVSVDGNSISGGVPGPVTQSIIRRYWELNVEPSSLLTPVQY

SEQ ID NO: 25 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 26 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 27 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgtttttgtttcaatcacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 28 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVFVSITRGYSSTPLERDITKHRPQVYMYAFPYQWIVPFDRIRDGVHLMVAQSVRRTPRSSIDPQVKNFQWGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 29 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttataattctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 30 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYNSDATYTVFHVWNGNAFRLGDHIERLFSNAESIRLIPPLTQDEVKEIALELVAKTELREAIVFVAITRGYSSTPLERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 31 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccagagcggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 32 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAAPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 33 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 34 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 35 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatgcttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 36 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYASDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 37 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttttggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 38 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVLVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 39 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttaaggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 40 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVKVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 41 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcacccgtcgttactgggaactgaacgttgaaccttcttctctgctgaccccggtacagtac

SEQ ID NO: 42 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSITRRYWELNVEPSSLLTPVQY

SEQ ID NO: 43 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccactggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 44 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTTGGVWPFVSVDGNSISDGVPGPVTQSIIRRYWELNVEPSSLLTPVQY

SEQ ID NO: 45 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatttgagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 46 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPFERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 47 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgtttgggtttcaatcacccgtggttactcttctaccccatgggagcgtgacatcaccaaacatcgtccgcaggtttacatgtatgctgttccgtaccagtggatcgtaccgcttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 48 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVWVSITRGYSSTPWERDITKHRPQVYMYAVPYQWIVPLDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 49 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggtttttgtttcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 50 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVFVSITRGYSSTPWERDITKHRPQVYMYAVPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 51 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggtttttgttgcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaactgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 52 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVFVAITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 53 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactccatctctgacggtgttccgggtccggttacccagtctatcatccgtcgttactgggaactgaacgttgaaccttcttctctgctgaccccggtacagtac

SEQ ID NO: 54 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 55 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcagtatcttcgaccagggtttttatacttctgatgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaagtccgtccgcaggtttacatgtctgctgttccgtaccaaacgattgtagggtttgaccgcatccgtgacggtgttcacctgatggttgctcagtcagttcgtcgtacaccgcgtagctctatcgacccgcaggttaaaaacttccaggcaggtgacctgattcgtgcaattcaggaaacccacgaccgtggtttcgagctgccgctgctgctggaccatgacaacctgctggctgaaggttcgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 56 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKVRPQVYMSAVPYQTIVGFDRIRDGVHLMVAQSVRRTPRSSIDPQVKNFQAGDLIRAIQETHDRGFELPLLLDHDNLLAEGSGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 57 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatccccatcgaagaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgaaaaaaccaaagtccgtccgcaggtttacatgtctgctgttccgtaccaaacgattgtaccttttgaccgcatccgtgacggtgttcacctgatggttgctcagtcagttcgtcgtacaccgcgtagctctatcgacccgcaggttaaaaacttccaggcaggtgacctgattcgtgcaattcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 58 - protein, 330 aa, Artificial Sequence
  Engineered variant of Arthrobacter transaminase
MAFSADTPEIVYTHDTGLDYITYSDYELDPANPLAGGAAWIEGAFVPPSEARIPIEDQGFYTSCATYTVFHVWNGNAFRLGDHIERLFSNAESIRLIPPLTQDEVKEIALELVAKTELREAIVWVAITRGYSSTPLEREKTKVRPQVYMSAVPYQTIVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 59 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgataaaaccaaagtccgtccgcaggtttacatgtatgctgttccgtacatcacgcttgtaccttttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggttcgggtttcaacattgttgttatcacagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 60 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDKTKVRPQVYMYAVPYITLVPFDRIRDGVHLMVAQSVRRTPRSSIDPQVKNFQAGDLIRAVQETHDRGFELPLLLDHDNLLAEGSGFNIVVITDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 61 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcagtatcttcgaccagggtttttatacttctgatgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgataaaaccaaacatcgtccgcaggtttacatgtctgctgttccgtacatctggattgtaccttttgaccgcatccgtgacggtgttcacctgatggttgctcagtcagttcgtcgtacaccgcgtagctctatcgacccgcaggttaaaaacttccaggcaggtgacctgcttcgtgcaattcaggaaacccacgaccgtggtttcgagctgccgctgctgctggaccatgacaacctgctggctgaaggtccgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 62 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDKTKHRPQVYMSAVPYIWIVPFDRIRDGVHLMVAQSVRRTPRSSIDPQVKNFQAGDLLRAIQETHDRGFELPLLLDHDNLLAEGPGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 63 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatccccatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaacatcgtccgcaggtttacatgtatgctgttccgtacatcacgcttgtaccttttgaccgcatccgtgacggtgttcacctgatggttgctcagtcagttcgtcgtacaccgcgtagctctatcgacccgcaggttaaaaacttccaggcaggtgacctgattcgtgcaattcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 64 - protein, 330 aa, Artificial Sequence
  Engineered variant of Arthrobacter transaminase
MAFSADTPEIVYTHDTGLDYITYSDYELDPANPLAGGAAWIEGAFVPPSEARIPIFDQGFYTSCATYTVFHVWNGNAFRLGDHIERLFSNAESIRLIPPLTQDEVKEIALELVAKTELREAIVWVAITRGYSSTPLERDITKHRPQVYMYAVPYITLVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 65 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatccccatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccatgggagcgtgaaataaccaaagtccgtccgcaggtttacatgtatgctgttccgtacatctggcttgtagggtttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 66 - protein, 330 aa, Artificial Sequence
  Engineered variant of Arthrobacter transaminase
MAFSADTPEIVYTHDTGLDYITYSDYELDPANPLAGGAAWIEGAFVPPSEARIPIFDQGFYTSCATYTVFHVWNGNAFRLGDHIERLFSNAESIRLIPPLTQDEVKEIALELVAKTELREAIVWVAITRGYSSTPWEREITKVRPQVYMYAVPYIWLVGFDRIRDGVHLMVAQSVRRTPRSSIDPQVKNFQAGDLIRAVQETHDRGFELPLLLDHDNLLAEGPGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 67 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctcatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 68 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSCATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 69 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctcatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggaccatgacaacctgctggctgaaggttcgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 70 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDHDNLLAEGSGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 71 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctcatcttcgaccagggtttttatacttctgatgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaacatcgtccgcaggtttacatgtatgctgttccgtacatcacgcttgtaccttttgaccgcatccgtgacggtgttcacctgatggttgctcagtcagttcgtcgtacaccgcgtagctctatcgacccgcaggttaaaaacttccaggcaggtgacctgattcgtgcaattcaggaaacccacgaccgtggtttcgagctgccgctgctgctggaccatgacaacctgctggctgaaggttcgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggcccggttacccagtctatcatccgtcgttactgggaactgaacgtcgaaccttcttctctgctgaccccggtacagtac

SEQ ID NO: 72 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYITLVPFDRIRDGVHLMVAQSVRRTPRSSIDPQVKNFQAGDLIRAIQETHDRGFELPLLLDHDNLLAEGSGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 73 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccatttgagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 74 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPFERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 75 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgcttggccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 76 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAWPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 77 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctattccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 78 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAIPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 79 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctctgccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 80 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYALPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 81 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagagtggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 82 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 83 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 84 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 85 - DNA, 990 bp, Artificial Sequence
  Engineered variant of Arthrobacter transaminase
atggcgttctcagcggacacccctgaaatcgtttacgcccacgacaccggtctggactatatcacctactctgactacgaactggacccggctaacccgctggctggtggtgctgcttggatcgaaggtgctttcgttccgccgtctgaagctcacatctctatcttcgaccagggtttttatacatctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcgcccgtggttactcttctaccccatgggagcgtgacatcaccaaacatcgtccgcaggtttacatgtatgctcttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcaagttaccgctgctgctggactgcgacaacctgctggctgaaggtccgggtttcaacgttgttgttatcaaagacggtgttgttcgttctccgggacgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgccgaccccggtacagtac

SEQ ID NO: 86 - protein, 330 aa, Artificial Sequence
  Engineered variant of Arthrobacter transaminase
MAFSADTPEIVYAHDTGLDYITYSDYELDPANPLAGGAAWIEGAFVPPSEAHISIFDQGFYTSDATYTVFHVWNGNAFRLGDHIERLFSNAESIRLIPPLTQDEVKEIALELVAKTELREAIVIVSIARGYSSTPWERDITKHRPQVYMYALPYQWIVPFDRIRDGVHLMVAQSVRRTPRSSIDPQVKNFQWGDLIRAIQETHDRGFKLPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLPTPVQY

SEQ ID NO: 87 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgcttgctggtggtgctgcttggatcgaaggtgctttcgttccgccgtctgaagctcgtatctctatcttcgaccagggtttttataattctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtaacggtgttcacctgatggttgctcagtcagttcgtcgtacaccgcgtagctcaatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 88 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYNSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRNGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 89 - DNA, 990 bp, Artificial Sequence
  Engineered variant of Arthrobacter transaminase
atggcgttctcagcggacacccctgaaatcgttcacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtcagggggaccacatcgaacgtctgttctctaatgcggaatctattcgtttgatcccgccgctgacccaggacgaagttaaagagatcgctctggaactggttgctaaaaccgaactgcgtgaagcgatcgttattgtttctatcacccgtggttactcttcttccccatgggagcgtgacatcaccaaacatcgtccgcaggtttacatgtatgctgttccgtaccagtggatcgtaccgtttgaccgcatccgtgacggtgttcacctgatggttgctcagtcagtttgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcatctctgctgaccccggtacagtac

SEQ ID NO: 90 - protein, 330 aa, Artificial Sequence
  Engineered variant of Arthrobacter transaminase
MAFSADTPEIVHTHDTGLDYITYSDYELDPANPLAGGAAWIEGAFVPPSEARISIFDQGFYTSDATYTVFHVWNGNAFRQGDHIERLFSNAESIRLIPPLTQDEVKEIALELVAKTELREAIVIVSITRGYSSSPWERDITKHRPQVYMYAVPYQWIVPFDRIRDGVHLMVAQSVCRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 91 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttggacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 92 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFWTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 93 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggttttggtacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 94 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFGTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 95 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttattcttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 96 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYSSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 97 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatttgtctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 98 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYLSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 99 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgcgttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 100 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTAFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 101 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcgcctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 102 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVRLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 103 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 104 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 105 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtatgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 106 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAYVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 107 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 108 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 109 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttaaggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 110 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVKVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 111 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttaatgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 112 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVNVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 113 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttctggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 114 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVLVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 115 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttttgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 116 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 117 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttgctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 118 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVAITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 119 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttattatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 120 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVIITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 121 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccaatggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 122 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPMERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 123 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacaccgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 124 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHTERLFSNAESIRLIPPLTQDEVKEIALELVAKTELREAIVIVSITRGYSSTPLERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 125 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatatgagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 126 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPYERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 127 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccaaaggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 128 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPKERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 129 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgcttgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 130 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMLAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 131 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 132 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAFPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 133 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgcttggccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttttggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 134 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAWPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 135 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagcatggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 136 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQHGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 137 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 138 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQGGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 139 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagcagggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 140 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQQGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 141 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagaagggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 142 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQKGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 143 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagcggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 144 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQRGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 145 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccccgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 146 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTPGGVWPFVSVDGNSISDGVPGPVTQSIIRRYWELNVEPSSLLTPVQY

SEQ ID NO: 147 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccagtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 148 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTSGGVWPFVSVDGNSISDGVPGPVTQSIIRRYWELNVEPSSLLTPVQY

SEQ ID NO: 149 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 150 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 151 - DNA, 990 bp, Artificial Sequence
  Engineered variant of Arthrobacter transaminase
atggcgttctcagcggacacccctgaaatcgtttacacccacgacactggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagcagccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 152 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFEQPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 153 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 154 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFEMPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 155 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcggaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttattgtttctatcacccgtggttactcttctaccccatgggagcgtgacatcaccaaacatcgtccgcaggtttacatgtccgctgtgccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 156 - protein, 330 aa, Artificial Sequence
  Engineered variant of Arthrobacter transaminase
MAFSADTPEIVYTHDTGLDYITYSDYELDPANPLAGGAAWIGGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMSAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 157 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttattgtttctatcacccgtggttactcttctaccccatgggagcgtgacatcaccaaacatcgtccgcaggtttacatgtacgcttgcccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggttccggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagtcctgggttgctctaccgggggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 158 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYACPYQWIVPFDRIRDGVHLMVAQSVRRTPRSSIDPQVKNFQWGDLIRAIQETHDRGFELPLLLDCDNLLAEGSGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 159 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttattgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggttccggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 160 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAMVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGSGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 161 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatggttattgtttctatcacccgtggttactcttctaccccatgggagcgtgacatcaccaaacatcgtccgcaggtttacatgtacgcttgcccgtaccagtggatcgtaccgtttgaccgcatccgtgacggtgttcacctgatggttgctcagtcagttcgtcgtacaccgcgtagctctatcgacccgcaggttaaaaacttccaggggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 162 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAMVIVSITRGYSSTPWERDITKHRPQVYMYACPYQWIVPFDRIRDGVHLMVAQSVRRTPRSSIDPQVKNFQGGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 163 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttattgtttctatcacccgtggttactcttctaccccatgggagcgtgacatcaccaaacatcgtccgcaggtttacatgtccgctgtgccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggttccggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctctaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 164 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMSAVPYQWIVPFDRIRDGVHLMVAQSVRRTPRSSIDPQVKNFQWGDLIRAIQETHDRGFELPLLLDCDNLLAEGSGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 165 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgttacgtgcagtccaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcgtgaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 166 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLLRAVQETHDRGFELPLLLDCDNLLAEGPGFNVVVIKDGVVRSPGRAALPGITRKTVLEIAESLGHEAILADITPAELYDADEVLGCVTVGGVWPFVSVDGNSISDGVPGPVTQSIIRRYWELNVEPSSLLTPVQY

SEQ ID NO: 167 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtgtgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 168 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGVGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 169 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgttacgtgcaatccaggaaacccacgaccgtggtttcgaggttccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcatcaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 170 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLLRAIQETHDRGFEVPLLLDCDNLLAEGPGFNVVVIKDGVVRSPGRAALPGITRKTVLEIAESLGHEAILADITPAELYDADEVLGCITGGGVWPFVSVDGNSISDGVPGPVTQSIIRRYWELNVEPSSLLTPVQY

SEQ ID NO: 171 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacatcgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctggtccgtgcactgcaggaaacccacgaccgtggtttcgagttaccgctgctgctggactgcgacaacctgctggctgaaggtaccggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgcctgaccgttggtggtgtttggccgttcgtttctgttgacggtaactctatctctgacggtgttccgggtccggttacccagtctatcatccgtcgttactgggaactgaacgttggaccttcttctctgctgaccccggtacagtac

SEQ ID NO: 172 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYIVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLVRALQETHDRGFELPLLLDCDNLLAEGTGFNVVVIKDGVVRSPGRAALPGITRKTVLEIAESLGHEAILADITPAELYDADEVLGCLTVGGVWPFVSVDGNSISDGVPGPVTQSIIRRYWELNVGPSSLLTPVQY

SEQ ID NO: 173 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtgactctatctctgacggtgttccgggtccggttacccagtctatcatccgtcgttactgggaactgaacgttgaaccttcttctctgctgaccccggtacagtac

SEQ ID NO: 174 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGDSISDGVPGPVTQSIIRRYWELNVEPSSLLTPVQY

SEQ ID NO: 175 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcagtccaggaaacccacgaccgtggtttcgaggttccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 176 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQWGDLIRAVQETHDRGFEVPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 177 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagttaccgctgctgctggactgcgacaacctgctggctgaaggtgtgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgctggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 178 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLIRAIQETHDRGFELPLLLDCDNLLAEGVGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 179 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgttcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtggggtgacctgatccgtgcaattcaggaaacccacgaccgtggtttcgagtttccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 180 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVIVSITRGYSSTPWERDITKHRPQVYMYAVPYQWIVPFDRIRDGVHLMVAQSVRRTPRSSIDPQVKNFQWGDLIRAIQETHDRGFEFPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 181 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagagcggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatctgtcgttactgggaactgaacgttgaaccttcttctctgctgaccccggtacagtac

SEQ ID NO: 182 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIICRYWELNVEPSSLLTPVQY

SEQ ID NO: 183 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaaccacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccagagcggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 184 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVATTRGYSSTPLERDITKHRPQVYMYAFPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 185 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgtttgggtttcaatcacccgtggttactcttctaccccattggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccagaacggtgacctgatccgtgcaattcaggaaacccacgaccgtggtttcgagatgccgctgctgctggactgtgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 186 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVWVSITRGYSSTPLERDITKHRPQVYMYAAPYQWIVPFDRIRDGVHLMVAQSVRRTPRSSIDPQVKNFQNGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 187 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggtttcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagagcggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 188 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 189 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgtcgacggtaactctatctctgacggtgttccgggtccggttacccagtctatcatccgtcgttactgggaactgaacgttgaaccttcttctctgctgaccccggtacagtac

SEQ ID NO: 190 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAFPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 191 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgtttgggttgcaatcacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 192 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVWVAITRGYSSTPLERDITKHRPQVYMYAFPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 193 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggtttcaatcacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 194 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAFPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 195 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgcttttgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtttgtttttgttgcaatcacccgtggttactcttctaccccattggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccagaacggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 196 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAFVFVAITRGYSSTPLERDITKHRPQVYMYAAPYQWIVPFDRIRDGVHLMVAQSVRRTPRSSIDPQVKNFQNGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 197 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggccggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 198 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 199 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccagggcgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggccggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgtcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 200 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQGEVKEIALELVAKTELREAIVWVSITRGYSSTPLERDITKHRPQVYMYAVPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 201 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggccggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 202 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELHDADEVLGCSTGGGVWPFVSVDGNSISDGVPGPVTQSIIRRYWELNVEPSSLLTPVQY

SEQ ID NO: 203 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtccggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgtcggtggtgtttggccgttcgtttctgttgacagtaactctatctctgacggtgttccgggtccggttacccagtctatcatccgtcgttactgggaactgaacgttgaaccttcttctctgctgaccccggtacagtac

SEQ ID NO: 204 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDSNSISDGVPGPVTQSIIRRYWELNVEPSSLLTPVQY

SEQ ID NO: 205 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggccggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgtcggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 206 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 207 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttgggtttctatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagtccggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 208 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPLERDITKHRPQVYMYAVPYQWIVPFDRIRDGVHLMVAQSVRRTPRSSIDPQVKNFQSGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 209 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttcgggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 210 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVRVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 211 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggatccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttttgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctaacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 212 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILANITPAELYDADEVLGCSTGGGVWPFVSVDGNSISDGVPGPVTQSIIRRYWELNVEPSSLLTPVQY

SEQ ID NO: 213 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgcttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttaaggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 214 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHAWNGNAFRLGDHIERLFSNAESIRLIPPLTQDEVKEIALELVAKTELREAIVKVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 215 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgtttctgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 216 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVSVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 217 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 218 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVMVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 219 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttattatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 220 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVIITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 221 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttgcgatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 222 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVAITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 223 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgttacgatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 224 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVTITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 225 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttgtatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 226 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVCITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 227 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctggtccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 228 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAGPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 229 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 230 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAAPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 231 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgcttctccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 232 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYASPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 233 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 234 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 235 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggaccttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 236 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDLDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 237 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 238 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 239 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccactttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 240 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTTFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 241 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgggttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 242 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTGFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 243 - DNA, 990 bp, Artificial Sequence
  Engineered variant of Arthrobacter transaminase
atggcgttctcagcggacacccccgaaatcgtttacttccacgacaccggtctggactatatcacctactctgactacgaactggacccggctaacccgctggctggtggtgctgcttggatcgaaggtgctttcgttccgccgtctgaagctcgtatcgcgatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 244 - protein, 330 aa, Artificial Sequence
  Engineered variant of Arthrobacter transaminase
MAFSADTPEIVYFHDTGLDYITYSDYELDPANPLAGGAAWIEGAFVPPSEARIAIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 245 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatccggatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 246 - protein, 330 aa, Artificial Sequence
  Engineered variant of Arthrobacter transaminase
MAFSADTPEIVYTHDTGLDYITYSDYELDPANPLAGGAAWIEGAFVPPSEARIRIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 247 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggctggtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 248 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWLVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 249 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtacctgtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 250 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYLWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 251 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtacatttggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 252 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYIWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 253 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaagttcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 254 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKVRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 255 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagacgatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 256 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQTIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 257 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaggttttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 258 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVGFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 259 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacaagaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctcaggtgaccccggtacagtac

SEQ ID NO: 260 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDKTKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSQVTPVQY

SEQ ID NO: 261 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatcccgatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 262 - protein, 330 aa, Artificial Sequence
  Engineered variant of Arthrobacter transaminase
MAFSADTPEIVYTHDTGLDYITYSDYELDPANPLAGGAAWIEGAFVPPSEARIPIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 263 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcgatgaccagggtttttatacttctgacgctacctacaccgtcttccacgtttggaacggtaacgccttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 264 - protein, 330 aa, Artificial Sequence
  Engineered variant of Arthrobacter transaminase
MAFSADTPEIVYTHDTGLDYITYSDYELDPANPLAGGAAWIEGAFVPPSEARISIDDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 265 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcgaggaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 266 - protein, 330 aa, Artificial Sequence
  Engineered variant of Arthrobacter transaminase
MAFSADTPEIVYTHDTGLDYITYSDYELDPANPLAGGAAWIEGAFVPPSEARISIEDQGFYTSDATYTVFHVWNGNAFRLGDHIERLFSNAESIRLIPPLTQDEVKEIALELVAKTELREAIVIVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 267 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtacacgtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 268 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYTWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 269 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccaggcgatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 270 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQAIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 271 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgttccgtaccagtcgatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 272 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAVPYQSIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 273 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgagatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 274 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWEREITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 275 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 276 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAAPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 277 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgatcgttatcgtttctatcacccgtggttactcttctaccccatgggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 278 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVIVSITRGYSSTPWERDITKHRPQVYMYAFPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 279 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggtttgggtttctatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 280 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVWVSITRGYSSTPWERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 281 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggtttgggttgcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 282 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVWVAITRGYSSTPWERDITKHRPQVYMYAVPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 283 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcagaatctattcgtttgatcccgccgctgacccaggacgaagttaaagagatcgctctggaactggttgctagaaccgtactgcgtgaagcgatcgttatcgtttctatcacccgtggttactcttctaccccatgggagcgtgacatcaccaaacatcgtccgcaggtttacatgtatgctgctccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 284 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVARTVLREAIVIVSITRGYSSTPWERDITKHRPQVYMYAAPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 285 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgtgggtttgggtttcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 286 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAWVWVSITRGYSSTPWERDITKHRPQVYMYAVPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 287 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggtttcaatcacccgtggttactcttctaccccatgggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagatgccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacgtcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 288 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVSITRGYSSTPWERDITKHRPQVYMYAVPYQWIVPFDRIRDGVHLMVAQSVRRTPRSSIDPQVKNFQAGDLIRAIQETHDRGFEMPLLLDCDNLLAEGPGFNVVVIKDGVVRSPGRAALPGITRKTVLEIAESLGHEAILADVTPAELYDADEVLGCSTGGGVWPFVSVDGNSISDGVPGPVTQSIIRRYWELNVEPSSLLTPVQY

SEQ ID NO: 289 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgtttcaatcacccgtggttactcttctaccccattggagcgtgacatcaccaaacatcgtccgcaggtttacatgtatgcttttccgtaccagtggatcgtaccgtttgaccgcatccgtgacggtgttcacctgatggttgctcagtcagttcgtcgtacaccgcgtagctctatcgacccgcaggttaaaaacttccaggctggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgttggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 290 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVSITRGYSSTPLERDITKHRPQVYMYAFPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTVGGVWPFVSVDGNSISDGVPGPVTQSIIRRYWELNVEPSSLLTPVQY

SEQ ID NO: 291 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcagtatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgaaataaccaaacatcgtccgcaggtttacatgtatgctgttccgtaccaatggattgtaccttttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 292 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSCATYTVFHVWNGNAFRLGDHIERLFSNAESIRLIPPLTQDEVKEIALELVAKTELREAIVWVAITRGYSSTPLEREITKHRPQVYMYAVPYQWIVPFDRIRDGVHLMVAQSVRRTPRSSIDPQVKNFQAGDLIRAVQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 293 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctcatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgataaaaccaaacatcgtccgcaggtttacatgtatgctgttccgtaccaatggattgtaccttttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgtcgaaccttcttctctgctgaccccggtacagtac

SEQ ID NO: 294 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSCATYTVFHVWNGNAFRLGDHIERLFSNAESIRLIPPLTQDEVKEIALELVAKTELREAIVWVAITRGYSSTPLERDKTKHRPQVYMYAVPYQWIVPFDRIRDGVHLMVAQSVRRTPRSSIDPQVKNFQAGDLIRAVQETHDRGFELPLLLDHDNLLAEGPGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 295 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcagtatcttcgaccagggtttttatacttctgatgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaacatcgtccgcaggtttacatgtatgctgttccgtacatctggcttgtaccttttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 296 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYIWLVPFDRIRDGVHLMVAQSVRRTPRSSIDPQVKNFQAGDLIRAVQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 297 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatccccatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaagtccgtccgcaggtttacatgtatgctgttccgtaccaatggcttgtagggtttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccctggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 298 - protein, 330 aa, Artificial Sequence
  Engineered variant of Arthrobacter transaminase
MAFSADTPEIVYTHDTGLDYITYSDYELDPANPLAGGAAWIEGAFVPPSEARIPIFDQGFYTSCATYTVFHVWNGNAFRLGDHIERLFSNAESIRLIPPLTQDEVKEIALELVAKTELREAIVWVAITRGYSSTPLERDITKVRPQVYMYAVPYQWLVGFDRIRDGVHLMVAQSVRRTPRSSIDPQVKNFQAGDLIRAVQETHDRGFELPLLLDHDNLLAEGPGFNVVVIKDGVVRSPGRAALPGITRKTVLEIAESLGHEAILADITLAELYDADEVLGCSTGGGVWPFVSVDGNSISDGVPGPVTQSIIRRYWELNVEPSSLLTPVQY

SEQ ID NO: 299 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctcatcttcgaccagggtttttatacttcttgcgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgatataaccaaacatcgtccgcaggtttacatgtatgctgttccgtacatcacgcttgtaccttttgaccgcatccgtgacggtgttcacctgatggttgctcagtcagttcgtcgtacaccgcgtagctctatcgacccgcaggttaaaaacttccaggcaggtgacctgattcgtgcaattcaggaaacccacgaccgtggtttcgagctgccgctgctgctggactgcgacaacctgctggctgaaggtccgggtttcaacattgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 300 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSCATYTVFHVWNGNAFRLGDHIERLFSNAESIRLIPPLTQDEVKEIALELVAKTELREAIVWVAITRGYSSTPLERDITKHRPQVYMYAVPYITLVPFDRIRDGVHLMVAQSVRRTPRSSIDPQVKNFQAGDLIRAIQETHDRGFELPLLLDCDNLLAEGPGFNIVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 301 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcagtatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgattcgtgcagttcaggaaacccacgaccgtggtttcgagctgccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 302 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAVQETHDRGFELPLLLDHDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 303 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctcgtccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccggtggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 304 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYARPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTGGGVWPFVSVDGNSISDGVPGPVTQSIIRRYWELNVEPSSLLTPVQY

SEQ ID NO: 305 - DNA, 990 bp, Artificial Sequence
  Engineered variant of Arthrobacter transaminase
atgatgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 306 - protein, 330 aa, Artificial Sequence
  Engineered variant of Arthrobacter transaminase
MMFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 307 - DNA, 990 bp, Artificial Sequence
  Engineered variant of Arthrobacter transaminase
atggcgttctcaacggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 308 - protein, 330 aa, Artificial Sequence
  Engineered variant of Arthrobacter transaminase
MAFSTDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 309 - DNA, 990 bp, Artificial Sequence
  Engineered variant of Arthrobacter transaminase
atggcgttctcagcggacaccccttttatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 310 - protein, 330 aa, Artificial Sequence
  Engineered variant of Arthrobacter transaminase
MAFSADTPFIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 311 - DNA, 990 bp, Artificial Sequence
  Engineered variant of Arthrobacter transaminase
atggcgttctcaccagacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 312 - protein, 330 aa, Artificial Sequence
  Engineered variant of Arthrobacter transaminase
MAFSPDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 313 - DNA, 990 bp, Artificial Sequence
  Engineered variant of Arthrobacter transaminase
atggcgttctcagcgtttacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 314 - protein, 330 aa, Artificial Sequence
  Engineered variant of Arthrobacter transaminase
MAFSAFTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 315 - DNA, 990 bp, Artificial Sequence
  Engineered variant of Arthrobacter transaminase
atggcgttctcagcggacacccctgaacttgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 316 - protein, 330 aa, Artificial Sequence
  Engineered variant of Arthrobacter transaminase
MAFSADTPELVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 317 - DNA, 990 bp, Artificial Sequence
  Engineered variant of Arthrobacter transaminase
atggcgttctcaaacgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 318 - protein, 330 aa, Artificial Sequence
  Engineered variant of Arthrobacter transaminase
MAFSNDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 319 - DNA, 990 bp, Artificial Sequence
  Engineered variant of Arthrobacter transaminase
atggcgttctcagcggacacccatgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 320 - protein, 330 aa, Artificial Sequence
  Engineered variant of Arthrobacter transaminase
MAFSADTHEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 321 - DNA, 990 bp, Artificial Sequence
  Engineered variant of Arthrobacter transaminase
atggcgttctcaatcgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 322 - protein, 330 aa, Artificial Sequence
  Engineered variant of Arthrobacter transaminase
MAFSIDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 323 - DNA, 990 bp, Artificial Sequence
  Engineered variant of Arthrobacter transaminase
atggcgttctcattggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 324 - protein, 330 aa, Artificial Sequence
  Engineered variant of Arthrobacter transaminase
MAFSLDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 325 - DNA, 990 bp, Artificial Sequence
  Engineered variant of Arthrobacter transaminase
atggcgttcttagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 326 - protein, 330 aa, Artificial Sequence
  Engineered variant of Arthrobacter transaminase
MAFLADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 327 - DNA, 990 bp, Artificial Sequence
  Engineered variant of Arthrobacter transaminase
atggcgttctcatgtgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 328 - protein, 330 aa, Artificial Sequence
  Engineered variant of Arthrobacter transaminase
MAFSCDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 329 - DNA, 990 bp, Artificial Sequence
  Engineered variant of Arthrobacter transaminase
atggcgttctcagcgtctacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 330 - protein, 330 aa, Artificial Sequence
  Engineered variant of Arthrobacter transaminase
MAFSASTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 331 - DNA, 990 bp, Artificial Sequence
  Engineered variant of Arthrobacter transaminase
atggcgttctttgcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 332 - protein, 330 aa, Artificial Sequence
  Engineered variant of Arthrobacter transaminase
MAFFADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 333 - DNA, 990 bp, Artificial Sequence
  Engineered variant of Arthrobacter transaminase
atggcgttctcagcggacacccctttaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 334 - protein, 330 aa, Artificial Sequence
  Engineered variant of Arthrobacter transaminase
MAFSADTPLIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 335 - DNA, 990 bp, Artificial Sequence
  Engineered variant of Arthrobacter transaminase
atggcgttctcaaaggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 336 - protein, 330 aa, Artificial Sequence
  Engineered variant of Arthrobacter transaminase
MAFSKDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 337 - DNA, 990 bp, Artificial Sequence
  Engineered variant of Arthrobacter transaminase
atggcgttctcagcggacacccctataatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 338 - protein, 330 aa, Artificial Sequence
  Engineered variant of Arthrobacter transaminase
MAFSADTPIIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 339 - DNA, 990 bp, Artificial Sequence
  Engineered variant of Arthrobacter transaminase
atggcgttctcagcgcgtacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 340 - protein, 330 aa, Artificial Sequence
  Engineered variant of Arthrobacter transaminase
MAFSARTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 341 - DNA, 990 bp, Artificial Sequence
  Engineered variant of Arthrobacter transaminase
atggcgttctcagcggacacccctcaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 342 - protein, 330 aa, Artificial Sequence
  Engineered variant of Arthrobacter transaminase
MAFSADTPQIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 343 - DNA, 990 bp, Artificial Sequence
  Engineered variant of Arthrobacter transaminase
atggcgttctatgcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 344 - protein, 330 aa, Artificial Sequence
  Engineered variant of Arthrobacter transaminase
MAFYADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 345 - DNA, 990 bp, Artificial Sequence
  Engineered variant of Arthrobacter transaminase
atggcgttctcagcgacaacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 346 - protein, 330 aa, Artificial Sequence
  Engineered variant of Arthrobacter transaminase
MAFSATTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 347 - DNA, 990 bp, Artificial Sequence
  Engineered variant of Arthrobacter transaminase
atggcgttctcacacgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 348 - protein, 330 aa, Artificial Sequence
  Engineered variant of Arthrobacter transaminase
MAFSHDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 349 - DNA, 990 bp, Artificial Sequence
  Engineered variant of Arthrobacter transaminase
atggcgttctcatacgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 350 - protein, 330 aa, Artificial Sequence
  Engineered variant of Arthrobacter transaminase
MAFSYDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 351 - DNA, 990 bp, Artificial Sequence
  Engineered variant of Arthrobacter transaminase
atggcgttctcatttgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 352 - protein, 330 aa, Artificial Sequence
  Engineered variant of Arthrobacter transaminase
MAFSFDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 353 - DNA, 990 bp, Artificial Sequence
  Engineered variant of Arthrobacter transaminase
atggcgttctcaatggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 354 - protein, 330 aa, Artificial Sequence
  Engineered variant of Arthrobacter transaminase
MAFSMDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 355 - DNA, 990 bp, Artificial Sequence
  Engineered variant of Arthrobacter transaminase
atggcgttctcagtagacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 356 - protein, 330 aa, Artificial Sequence
  Engineered variant of Arthrobacter transaminase
MAFSVDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 357 - DNA, 990 bp, Artificial Sequence
  Engineered variant of Arthrobacter transaminase
atggcgttctcatctgacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 358 - protein, 330 aa, Artificial Sequence
  Engineered variant of Arthrobacter transaminase
MAFSSDTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 359 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatgcgtctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 360 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYASDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 361 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 362 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 363 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgttttggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 364 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVLVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 365 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttcttggccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 366 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSWPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 367 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccatttgagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 368 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPFERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 369 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacatgcaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 370 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNMQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 371 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 372 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 373 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggacttggacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 374 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDLDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 375 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggaccatgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 376 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDHDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 377 - DNA, 990 bp, Artificial Sequence
  Engineered variant of Arthrobacter transaminase
atggcgttctcagcggacacccctgaaatcgtttacacccacgacaccggtctggactatatcgcttactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 378 - protein, 330 aa, Artificial Sequence
  Engineered variant of Arthrobacter transaminase
MAFSADTPEIVYTHDTGLDYIAYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 379 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtagggctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 380 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRRALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 381 - DNA, 990 bp, Artificial Sequence
  Engineered variant of Arthrobacter transaminase
atggcgttctcagcggacacccctgaaatcgtttacacccacgacaccggtctggactatatccattactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 382 - protein, 330 aa, Artificial Sequence
  Engineered variant of Arthrobacter transaminase
MAFSADTPEIVYTHDTGLDYIHYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 383 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagagtatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 384 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQSIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 385 - DNA, 990 bp, Artificial Sequence
  Engineered variant of Arthrobacter transaminase
atggcgttctcagcggacacccctgaaatcgtttacacccacgacaccggtattgactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 386 - protein, 330 aa, Artificial Sequence
  Engineered variant of Arthrobacter transaminase
MAFSADTPEIVYTHDTGIDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 387 - DNA, 990 bp, Artificial Sequence
  Engineered variant of Arthrobacter transaminase
atggcgttctcagcggacacccctgaaatcgtttacacccacgacaccggtctggactatatcacctactctgcgtacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 388 - protein, 330 aa, Artificial Sequence
  Engineered variant of Arthrobacter transaminase
MAFSADTPEIVYTHDTGLDYITYSAYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 389 - DNA, 990 bp, Artificial Sequence
  Engineered variant of Arthrobacter transaminase
atggcgttctcagcggacacccctgaaatcgtttacacccacgacaccctgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 390 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 391 - DNA, 990 bp, Artificial Sequence
  Engineered variant of Arthrobacter transaminase
atggcgttctcagcggacacccctgaaatcgtttacacccacgacaccggtctggactatatcacctactctgactacctgctggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 392 - protein, 330 aa, Artificial Sequence
  Engineered variant of Arthrobacter transaminase
MAFSADTPEIVYTHDTGLDYITYSDYLLDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 393 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacggggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 394 - protein, 330 aa, Artificial Sequence
  Engineered variant of Arthrobacter transaminase
MAFSADTPEIVYTHDTGLDYITYSDYELDGANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 395 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcatgatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 396 - protein, 330 aa, Artificial Sequence
  Engineered variant of Arthrobacter transaminase
MAFSADTPEIVYTHDTGLDYITYSDYELDPANPLAGGAAWIEGAFVPPSEARIMIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 397 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccgcataacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 398 - protein, 330 aa, Artificial Sequence
  Engineered variant of Arthrobacter transaminase
MAFSADTPEIVYTHDTGLDYITYSDYELDPHNPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 399 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccgcggaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 400 - protein, 330 aa, Artificial Sequence
  Engineered variant of Arthrobacter transaminase
MAFSADTPEIVYTHDTGLDYITYSDYELDPRNPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 401 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccggttgctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 402 - protein, 330 aa, Artificial Sequence
  Engineered variant of Arthrobacter transaminase
MAFSADTPEIVYTHDTGLDYITYSDYELDPANPVAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 403 - DNA, 990 bp, Artificial Sequence
  Engineered variant of Arthrobacter transaminase
atggcgttctcagcggacacccctgaaatcgtttacacccacgacaccggtctggactatatcacctactctgactaccatctggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 404 - protein, 330 aa, Artificial Sequence
  Engineered variant of Arthrobacter transaminase
MAFSADTPEIVYTHDTGLDYITYSDYHLDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 405 - DNA, 990 bp, Artificial Sequence
  Engineered variant of Arthrobacter transaminase
atggcgttctcagcggacacccctgaaatcgtttacacccacgacaccggtctggactatatcacctactctgactacgaactgaatccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 406 - protein, 330 aa, Artificial Sequence
  Engineered variant of Arthrobacter transaminase
MAFSADTPEIVYTHDTGLDYITYSDYELNPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 407 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggactttgctaacccgctggctggtggtgctgcttggatcgaaagtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 408 - protein, 330 aa, Artificial Sequence
  Engineered variant of Arthrobacter transaminase
MAFSADTPEIVYTHDTGLDYITYSDYELDFANPLAGGAAWIESAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 409 - DNA, 990 bp, Artificial Sequence
  Engineered variant of Arthrobacter transaminase
atggcgttctcagcggacacccctgaaatcgtttacacccacgacaccggtctggactatatcacctactctgactacgaactgacgccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 410 - protein, 330 aa, Artificial Sequence
  Engineered variant of Arthrobacter transaminase
MAFSADTPEIVYTHDTGLDYITYSDYELTPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 411 - DNA, 990 bp, Artificial Sequence
  Engineered variant of Arthrobacter transaminase
atggcgttctcagcggacacccctgaaatcgtttacacccacgacaccggtctggactatatcacctactctgactacgaaaatgacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 412 - protein, 330 aa, Artificial Sequence
  Engineered variant of Arthrobacter transaminase
MAFSADTPEIVYTHDTGLDYITYSDYENDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 413 - DNA, 990 bp, Artificial Sequence
  Engineered variant of Arthrobacter transaminase
atggcgttctcagcggacacccctgaaatcgtttacacccacgacaccggtctggactatatcacctactctgactaccctctggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 414 - protein, 330 aa, Artificial Sequence
  Engineered variant of Arthrobacter transaminase
MAFSADTPEIVYTHDTGLDYITYSDYPLDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 415 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacgcgaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 416 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDATKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 417 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaggtctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 418 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELGLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 419 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacacgaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 420 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDTTKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 421 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaagtgcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgagctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 422 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKVRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 423 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatgaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 424 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDMTKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 425 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcaggatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 426 - protein, 330 aa, Artificial Sequence
  Engineered variant of Arthrobacter transaminase
MAFSADTPEIVYTHDTGLDYITYSDYELDPANPLAGGAAWIEGAFVPPSEARIRIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 427 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtcttcggctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 428 - protein, 330 aa, Artificial Sequence
  Engineered variant of Arthrobacter transaminase
MAFSADTPEIVYTHDTGLDYITYSDYELDPANPLAGGAAWIEGAFVPPSSARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 429 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgattgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 430 - protein, 330 aa, Artificial Sequence
  Engineered variant of Arthrobacter transaminase
MAFSADTPEIVYTHDTGLDYITYSDYELDPANPLAGGAAWIEGAFVPPIEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 431 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttaggccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 432 - protein, 330 aa, Artificial Sequence
  Engineered variant of Arthrobacter transaminase
MAFSADTPEIVYTHDTGLDYITYSDYELDPANPLAGGAAWIEGAFVRPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 433 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgcctccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 434 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLPPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 435 - DNA, 990 bp, Artificial Sequence
  Engineered variant of Arthrobacter transaminase
atggcgttctcagcggacacccccgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcttgcgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 436 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHILRLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 437 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaccactgacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 438 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTTDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 439 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 440 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 441 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacctgggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 442 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTWDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 443 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaaagcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 444 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTKRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 445 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 446 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFMRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 447 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcgggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 448 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPRVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 449 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtctggttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 450 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGLVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 451 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacgatgttgttcgttctccgggtcgtgctgctctgccgggtatcacccgtaaaaccgttctggaaatcgctgaatctctgggtcacgaagctatcctggctgacatcaccccggctgaactgcgtgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 452 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDDVVRSPGRAALPGITRKTVLEIAESLGHEAILADITPAELRDADEVLGCSTAGGVWPFVSVDGNSISDGVPGPVTQSIIRRYWELNVEPSSLLTPVQY

SEQ ID NO: 453 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccacggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 454 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITTAELYDADEVLGCSTAGGVWPFVSVDGNSISDGVPGPVTQSIIRRYWELNVEPSSLLTPVQY

SEQ ID NO: 455 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacctggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 456 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYLADEVLGCSTAGGVWPFVSVDGNSISDGVPGPVTQSIIRRYWELNVEPSSLLTPVQY

SEQ ID NO: 457 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgagggacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 458 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSSLLTPVQY

SEQ ID NO: 459 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttctctgctgaccccggtacagtac

SEQ ID NO: 460 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGSSISDGVPGPVTQSIIRRYWELNVEPSSLLTPVQY

SEQ ID NO: 461 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggttggtctatctctgacggtgttccgggtccggttacccagtctatcatccgtcgttactgggaactgaacgttgaaccttcttctctgctgaccccggtacagtac

SEQ ID NO: 462 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGWSISDGVPGPVTQSIIRRYWELNVEPSSLLTPVQY

SEQ ID NO: 463 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctgtatgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 464 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILYDITPAELYDADEVLGCSTAGGVWPFVSVDGNSISDGVPGPVTQSIIRRYWELNVEPSSLLTPVQY

SEQ ID NO: 465 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctgtgggacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 466 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILWDITPAELYDADEVLGCSTAGGVWPFVSVDGNSISDGVPGPVTQSIIRRYWELNVEPSSLLTPVQY

SEQ ID NO: 467 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactggtggacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 468 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 469 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgcgtgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 470 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPRELYDADEVLGCSTAGGVWPFVSVDGNSISDGVPGPVTQSIIRRYWELNVEPSSLLTPVQY

SEQ ID NO: 471 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactggatgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 472 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELDDADEVLGCSTAGGVWPFVSVDGNSISDGVPGPVTQSIIRRYWELNVEPSSLLTPVQY

SEQ ID NO: 473 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacacggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 474 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYTADEVLGCSTAGGVWPFVSVDGNSISDGVPGPVTQSIIRRYWELNVEPSSLLTPVQY

SEQ ID NO: 475 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttctctgctgaccccggtacagtac

SEQ ID NO: 476 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGRSISDGVPGPVTQSIIRRYWELNVEPSSLLTPVQY

SEQ ID NO: 477 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacagggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 478 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYRADEVLGCSTAGGVWPFVSVDGNSISDGVPGPVTQSIIRRYWELNVEPSSLLTPVQY

SEQ ID NO: 479 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtactttgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 480 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYFADEVLGCSTAGGVWPFVSVDGNSISDGVPGPVTQSIIRRYWELNVEPSSLLTPVQY

SEQ ID NO: 481 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 482 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSSLLTPVQY

SEQ ID NO: 483 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcaggtggtgtttggccgttcgtttctgttgacggtaactctatttctgacggtgttccgggtccggttacccagtctatcatccgtcgttactgggaactgaacgttgaaccttcttctctgctgaccccggtacagtac

SEQ ID NO: 484 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 485 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacaataactctatctctgacggtgttccgggtccggttacccagtctatcatccgtcgttactgggaactgaacgttgaaccttcttctctgctgaccccggtacagtac

SEQ ID NO: 486 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDNNSISDGVPGPVTQSIIRRYWELNVEPSSLLTPVQY

SEQ ID NO: 487 - DNA, 990 bp, Artificial Sequence
  Engineered variant of Arthrobacter transaminase
atggcgttctcagcggacacccatgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaacggtatctctgacggtgttccgggtccggttacccagtctatcatccgtcgttactgggaactgaacgttgaaccttcttctctgctgaccccggtacagtac

SEQ ID NO: 488 - protein, 330 aa, Artificial Sequence
  Engineered variant of Arthrobacter transaminase
MAFSADTHEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNGISDGVPGPVTQSIIRRYWELNVEPSSLLTPVQY

SEQ ID NO: 489 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctctgggtgttccgggtccggttacccagtctatcatccgtcgttactgggaactgaacgttgaaccttcttctctgctgaccccggtacagtac

SEQ ID NO: 490 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISLGVPGPVTQSIIRRYWELNVEPSSLLTPVQY

SEQ ID NO: 491 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaacgatatctctgacggtgttccgggtccggttacccagtctatcatccgtcgttactgggaactgaacgttgaaccttcttctctgctgaccccggtacagtac

SEQ ID NO: 492 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNDISDGVPGPVTQSIIRRYWELNVEPSSLLTPVQY

SEQ ID NO: 493 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttctgagctgctgaccccggtacagtac

SEQ ID NO: 494 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSELLTPVQY

SEQ ID NO: 495 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaacttaacgttgaaccttcttctctgatgaccccggtacagtac

SEQ ID NO: 496 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLMTPVQY

SEQ ID NO: 497 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatcatgcgttactgggaactgaacgttgaaccttcttctctgctgaccccggtacagtac

SEQ ID NO: 498 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIMRYWELNVEPSSLLTPVQY

SEQ ID NO: 499 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacagggaaccttcttctctgctgaccccggtacagtac

SEQ ID NO: 500 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNREPSSLLTPVQY

SEQ ID NO: 501 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgtctgctgaccccggtacagtac

SEQ ID NO: 502 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSCLLTPVQY

SEQ ID NO: 503 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactggcttctgaacgttgaaccttcttctctgctgaccccggtacagtac

SEQ ID NO: 504 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWLLNVEPSSLLTPVQY

SEQ ID NO: 505 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttcagccttcttctctgctgaccccggtacagtac

SEQ ID NO: 506 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVQPSSLLTPVQY

SEQ ID NO: 507 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactggcgtctgaacgttgaaccttcttctctgctgaccccggtacagtac

SEQ ID NO: 508 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWRLNVEPSSLLTPVQY

SEQ ID NO: 509 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttaccgcgtctatcatccgtcgttactgggaactgaacgttgaaccttcttctctgctgaccccggtacagtac

SEQ ID NO: 510 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTASIIRRYWELNVEPSSLLTPVQY

SEQ ID NO: 511 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtggatcatccgtcgttactgggaactgaacgttgaaccttcttctctgctgaccccggtacagtac

SEQ ID NO: 512 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQWIIRRYWELNVEPSSLLTPVQY

SEQ ID NO: 513 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagcttatcatccgtcgttactgggaactgaacgttgaaccttcttctctgctgaccccggtacagtac

SEQ ID NO: 514 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQLIIRRYWELNVEPSSLLTPVQY

SEQ ID NO: 515 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccttac

SEQ ID NO: 516 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVPY

SEQ ID NO: 517 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacacggaaccttcttctctgctgaccccggtacagtac

SEQ ID NO: 518 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNTEPSSLLTPVQY

SEQ ID NO: 519 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaactatgaaccttcttctctgctgaccccggtacagtac

SEQ ID NO: 520 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNYEPSSLLTPVQY

SEQ ID NO: 521 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtcaggttacccagtctatcatccgtcgttactgggaactgaacgttgaaccttcttctctgctgaccccggtacagtac

SEQ ID NO: 522 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGQVTQSIIRRYWELNVEPSSLLTPVQY

SEQ ID NO: 523 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactgcgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttctcggctgctgaccccggtacagtac

SEQ ID NO: 524 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDCDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSRLLTPVQY

SEQ ID NO: 525 - DNA, 990 bp, Artificial Sequence
  Engineered variant of Arthrobacter transaminase
atggcgttctcaaagtctacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 526 - protein, 330 aa, Artificial Sequence
  Engineered variant of Arthrobacter transaminase
MAFSKSTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 527 - DNA, 990 bp, Artificial Sequence
  Engineered variant of Arthrobacter transaminase
atggcgttctcactgtctacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 528 - protein, 330 aa, Artificial Sequence
  Engineered variant of Arthrobacter transaminase
MAFSLSTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 529 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtcttctgctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 530 - protein, 330 aa, Artificial Sequence
  Engineered variant of Arthrobacter transaminase
MAFSADTPEIVYTHDTGLDYITYSDYELDPANPLAGGAAWIEGAFVPPSSARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVPY

SEQ ID NO: 531 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacctgggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtttggttcgttctccgggtcgtgctgctctgccgggtatcacccgtaaaaccgttctggaaatcgctgaatctctgggtcacgaagctatcctggctgacatcaccccggccgaactgtacgatgctgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttctctgctgaccccggtaccgtac

SEQ ID NO: 532 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTWDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGLVRSPGRAALPGITRKTVLEIAESLGHEAILADITPAELYDADEVLGCSTAGGVWPFVSVDGRSISDGVPGPVTQSIIRRYWELNVEPSSLLTPVPY

SEQ ID NO: 533 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagctgatcatccgtcgttactgggaactgaacgttgaaccttcttctctgctgaccccggtacagtac

SEQ ID NO: 534 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQLIIRRYWELNVEPSSLLTPVQY

SEQ ID NO: 535 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 536 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFMRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 537 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgcgtgaactggttgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 538 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPRELVDADEVLGCSTAGGVWPFVSVDGNSISDGVPGPVTQSIIRRYWELNVEPSSLLTPVQY

SEQ ID NO: 539 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagctgatcatccgtcgttactgggaactgaacactgaaccttcttctctgctgaccccggtacagtac

SEQ ID NO: 540 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQLIIRRYWELNTEPSSLLTPVQY

SEQ ID NO: 541 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaccacggacgaagttaaagagatcgctctggaactggttgctaaaaccgaactgcgtgaagcgattgtttgggttgcaatcacccgtggttactcttctaccccattggagcgtgacatcaccaaacatcgtccgcgtgtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgcgtgaactgtacgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 542 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTTDEVKEIALELVAKTELREAIVWVAITRGYSSTPLERDITKHRPRVYMYAVPYQWIVPFMRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPRELYDADEVLGCSTAGGVWPFVSVDGNSISDGVPGPVTQSIIRRYWELNVEPSSLLTPVPY

SEQ ID NO: 543 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcgtgtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 544 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPRVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVPY

SEQ ID NO: 545 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacctggctgacgaagttctgggttgctcaaccgcgggtggtgtttggccgttcgtttctgttgacggtaactctatctctgacggtgttccgggtccggttacccagtctatcatccgtcgttactgggaactgaacactgaaccttcttctctgctgaccccggtaccgtac

SEQ ID NO: 546 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYLADEVLGCSTAGGVWPFVSVDGNSISDGVPGPVTQSIIRRYWELNTEPSSLLTPVPY

SEQ ID NO: 547 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcgtgtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactggttgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 548 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPRVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVQY

SEQ ID NO: 549 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactgtacctggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 550 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYLADEVLGCSTAGGVWPFVSVDGNSISDGVPGPVTQSIIRRYWELNVEPSSLLTPVQY

SEQ ID NO: 551 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacctgggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactggttgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 552 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTWDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELVDADEVLGCSTAGGVWPFVSVDGNSISDGVPGPVTQSIIRRYWELNVEPSSLLTPVPY

SEQ ID NO: 553 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactggttctggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 554 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELVLADEVLGCSTAGGVWPFVSVDGNSISDGVPGPVTQSIIRRYWELNVEPSSLLTPVQY

SEQ ID NO: 555 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 556 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFMRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVPY

SEQ ID NO: 557 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaccacggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgcgtgaactggttctggctgacgaagttctgggttgctcaaccgcgggtggtgtttggccgttcgtttctgttgacggtaactctatctctgacggtgttccgggtccggttacccagtctatcatccgtcgttactgggaactgaacactgaaccttcttctctgctgaccccggtacagtac

SEQ ID NO: 558 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTTDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPRELVLADEVLGCSTAGGVWPFVSVDGNSISDGVPGPVTQSIIRRYWELNTEPSSLLTPVQY

SEQ ID NO: 559 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaccacggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggccgaactggttctggctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 560 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTTDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELVLADEVLGCSTAGGVWPFVSVDGNSISDGVPGPVTQSIIRRYWELNVEPSSLLTPVQY

SEQ ID NO: 561 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttctctgctgaccccggtacagtac

SEQ ID NO: 562 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGRSISDGVPGPVTQSIIRRYWELNVEPSSLLTPVQY

SEQ ID NO: 563 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacctgggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtttggttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 564 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTWDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGLVRSPGRAALPGITRKTVLEIAESLGHEAILADITPAELYDADEVLGCSTAGGVWPFVSVDGNSISDGVPGPVTQSIIRRYWELNVEPSSLLTPVPY

SEQ ID NO: 565 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagctgatcatccgtcgttactgggaactgaacactgaaccttcttctctgctgaccccggtaccgtac

SEQ ID NO: 566 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQLIIRRYWELNTEPSSLLTPVPY

SEQ ID NO: 567 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtttggttcgttctccgggtcgtgctgctctgccgggtatcacccgtaaaaccgttctggaaatcgctgaatctctgggtcacgaagctatcctggctgacatcaccccggccgaactgtacgatgctgacgaagttctgggttgctcaaccgcgggtggtgtttggccgttcgtttctgttgacggtaactctatctctgacggtgttccgggtccggttacccagtctatcatccgtcgttactgggaactgaacactgaaccttcttctctgctgaccccggtacagtac

SEQ ID NO: 568 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFMRIRDGVHLMVAQSVRRTPRSSIDPQVKNFQAGDLIRAIQETHDRGFELPLLLDFDNLLAEGPGFNVVVIKDGLVRSPGRAALPGITRKTVLEIAESLGHEAILADITPAELYDADEVLGCSTAGGVWPFVSVDGNSISDGVPGPVTQSIIRRYWELNTEPSSLLTPVQY

SEQ ID NO: 569 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgcgtgaactgtacgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtaccgtac

SEQ ID NO: 570 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPRELYDADEVLGCSTAGGVWPFVSVDGNSISDGVPGPVTQSIIRRYWELNVEPSSLLTPVPY

SEQ ID NO: 571 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttatgcgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctgtgggacatcaccccggctgaactgtacgacgctgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttctctgctgaccccggtaccgtac

SEQ ID NO: 572 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFMRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILWDITPAELYDADEVLGCSTAGGVWPFVSVDGRSISDGVPGPVTQSIIRRYWELNVEPSSLLTPVPY

SEQ ID NO: 573 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgatgccgacgaagttctgggttgctcaaccgcgggtggtgtttggccgttcgtttctgttgacggtaactctatctctgacggtgttccgggtccggttacccagtctatcatccgtcgttactggctgctgaacgttgaaccttcttctctgctgaccccggtacagtac

SEQ ID NO: 574 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWLLNVEPSSLLTPVQY

SEQ ID NO: 575 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttcagttgacggttggagcatctctgacggtgttccgggtccggttacccagtctatcatccgtcgttactgggaactgaacgttgaaccttcttgcctgctgaccccggtacagtac

SEQ ID NO: 576 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGWSISDGVPGPVTQSIIRRYWELNVEPSCLLTPVQY

SEQ ID NO: 577 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtttcgcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 578 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELRFAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSSLLTPVQY

SEQ ID NO: 579 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 580 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWELNVEPSSLLTPVQY

SEQ ID NO: 581 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 582 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 583 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 584 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWELNVEPSCLLTPVQY

SEQ ID NO: 585 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtctatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtacagccgacgaagttctgggttgctcaaccgcgggtggtgtttggccgttcgtttcagttgacggtagtagcatctctgacggtgttccgggtccggttacccagtctatcatccgtcgttactgggaactgaacgttgaaccttcttgcctgctgaccccggtacagtac

SEQ ID NO: 586 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQSIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRTADEVLGCSTAGGVWPFVSVDGSSISDGVPGPVTQSIIRRYWELNVEPSCLLTPVQY

SEQ ID NO: 587 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 588 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 589 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttcagttgacggttggagcatctctgacggtgttccgggtccggttacccagtctatcatccgtcgttactgggaactgaacgttgaaccttcttgcctgctgaccccggtacagtac

SEQ ID NO: 590 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGWSISDGVPGPVTQSIIRRYWELNVEPSCLLTPVQY

SEQ ID NO: 591 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtttcgcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 592 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELRFAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 593 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtctatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 594 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQSIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWELNVEPSCLLTPVQY

SEQ ID NO: 595 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtttcgcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 596 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELRFAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSCLLTPVQY

SEQ ID NO: 597 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 598 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSSLLTPVQY

SEQ ID NO: 599 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 600 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYTADEVLGCSTAGGVWPFVSVDGNSISDGVPGPVTQSIIRRYWELNVEPSCLLTPVQY

SEQ ID NO: 601 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 602 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYTADEVLGCSTAGGVWPFVSVDGNSISDGVPGPVTQSIIRRYWELNVEPSSLLTPVQY

SEQ ID NO: 603 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 604 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 605 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 606 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSSLLTPVQY

SEQ ID NO: 607 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 608 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSCLLTPVQY

SEQ ID NO: 609 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttcagttgacggtaatagcatctctgacggtgttccgggtccggttacccagtctatcatccgtcgttactgggaactgaacgttgaaccttcttgcctgctgaccccggtacagtac

SEQ ID NO: 610 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSCLLTPVQY

SEQ ID NO: 611 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtctatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccagttacccagtctatcatccgtcgttactggctgctgaacgttgaaccttcttctctgctgaccccggtacagtac

SEQ ID NO: 612 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQSIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWLLNVEPSSLLTPVQY

SEQ ID NO: 613 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactggctgctgaacgttgaaccttcttctctgctgaccccggtacagtac

SEQ ID NO: 614 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWLLNVEPSSLLTPVQY

SEQ ID NO: 615 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatggatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 616 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMDADEVLGCSTAGGVWPFVSVDGNSISDGVPGPVTQSIIRRYWELNVEPSSLLTPVQY

SEQ ID NO: 617 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 618 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 619 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 620 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 621 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtttcgcgattgtttgggttgcaatcacccgtggttactcttctaccccattggagcgtgacatcaccaaacatcgtccgcaggtttacatgtatgctgttccgtaccagtctatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 622 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLWSNAESIRLIPPLTQDEVKEIALELVAKTELRFAIVWVAITRGYSSTPLERDITKHRPQVYMYAVPYQSIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWELNVEPSSLLTPVQY

SEQ ID NO: 623 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtttcgcgattgtttgggttgcaatcacccgtggttactcttctaccccattggagcgtgacatcaccaaacatcgtccgcaggtttacatgtatgctgttccgtaccagtctatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgatgacagccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 624 - protein, 330 aa, Artificial Sequence
  Engineered variant of Arthrobacter transaminase
MAFSADTPEIVYTHDTLLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELRFAIVWVAITRGYSSTPLERDITKHRPQVYMYAVPYQSIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELMTADEVLGCSTAGGVWPFVSVDGNSISDGVPGPVTQSIIRRYWELNVEPSCLLTPVQY

SEQ ID NO: 625 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttcagttgacggttggggcatctctgacggtgttccgggtccggttacccagtctatcatccgtcgttactgggaactgaacgttgaaccttcttgcctgctgaccccggtacagtac

SEQ ID NO: 626 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGWGISDGVPGPVTQSIIRRYWELNVEPSCLLTPVQY

SEQ ID NO: 627 - DNA, 990 bp, Artificial Sequence
  Engineered variant of Arthrobacter transaminase
atggcgttctcagcggacacccctgaaatcgtttacacccacgacaccttgctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtatgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttctctgctgaccccggtacagtac

SEQ ID NO: 628 - protein, 330 aa, Artificial Sequence
  Engineered variant of Arthrobacter transaminase
MAFSADTPEIVYTHDTLLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSSLLTPVQY

SEQ ID NO: 629 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcttctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgtacgacgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 630 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELYDADEVLGCSTAGGVWPFVSVDGNSISDGVPGPVTQSIIRRYWELNVEPSCLLTPVQY

SEQ ID NO: 631 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtttagccgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttgcctgctgaccccggtacagtac

SEQ ID NO: 632 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRLADEVLGCSTAGGVWPFVSVDGRSISDGVPGPVTQSIIRRYWELNVEPSCLLTPVQY

SEQ ID NO: 633 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaaaacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 634 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 635 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttgcctgctgaccccggtacagtac

SEQ ID NO: 636 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGRSISDGVPGPVTQSIIRRYWELNVEPSCLLTPVQY

SEQ ID NO: 637 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 638 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 639 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaaaacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 640 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 641 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 642 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 643 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtgctctaatgcggaatctattcgtttgatcccgccgctgaccacaaacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 644 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLCSNAESIRLIPPLTTNEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 645 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgagctctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgaccacagacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 646 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTTDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 647 - DNA, 990 bp, Artificial Sequence
  Engineered variant of Arthrobacter transaminase
atggcgttctcagcggacacccctgaaatcgtttacacccacgacaccggtctggactatctgacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 648 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 649 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgggttctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 650 - protein, 330 aa, Artificial Sequence
  Engineered variant of Arthrobacter transaminase
MAFSADTPEIVYTHDTGLDYITYSDYELDPANPLAGGAAWIEGAFVPGSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 651 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgcggtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 652 - protein, 330 aa, Artificial Sequence
  Engineered variant of Arthrobacter transaminase
MAFSADTPEIVYTHDTGLDYITYSDYELDPANPLAGGAAWIEGAFVPRSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 653 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctgcttacaccgtcttccacgtttggaacggtaacgctttccgtctgggggaccacatcgaacgtctgttctctaatgcggaatctattcgtttgatcccaccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 654 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDAAYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 655 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatctgggaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 656 - protein, 330 aa, Artificial Sequence
  Engineered variant of Arthrobacter transaminase
MAFSADTPEIVYTHDTGLDYITYSDYELDPANPLAGGAAWIEGAFVPPSEARISIWDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 657 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttattgttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 658 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYCSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 659 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctagttacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 660 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDASYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 661 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtggtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 662 - protein, 330 aa, Artificial Sequence
  Engineered variant of Arthrobacter transaminase
MAFSADTPEIVYTHDTGLDYITYSDYELDPANPLAGGAAWIEGAFVPWSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 663 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgttgacccaggacgaagttaaagagatcgctctggaactggttgctaaaaccgaactgcgtgaagcgattgtttttgttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 664 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVFVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 665 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtgggtactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgcagaccccggtacagtac

SEQ ID NO: 666 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLQTPVQY

SEQ ID NO: 667 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttggtatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggcgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 668 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVGITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 669 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctgttccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgagccttcttgcctgctgaccccggtacagtac

SEQ ID NO: 670 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSVPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 671 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctgggccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 672 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSGPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 673 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttcttatccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 674 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSYPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 675 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccatatgagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 676 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPYERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 677 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 678 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSLPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 679 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccatgcatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 680 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITMHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 681 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtacctttggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 682 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYLWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 683 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacgcgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 684 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDAQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 685 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtacatttggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgaattaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 686 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYIWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 687 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttagctctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 688 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELALLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 689 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttctcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttactcagtctatcatccgtcgttactgggaactgaacgttgaaccttcttgcctgctgaccccggtacagtac

SEQ ID NO: 690 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFSAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 691 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcggggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 692 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFGAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 693 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttagggctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 694 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELGLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 695 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 696 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 697 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccagagtggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 698 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQSGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 699 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggcgacctgatccgtgcaattcaggaaacccacgaccgtggtttcgagttaagtctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 700 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELSLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 701 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgcctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggttctggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 702 - protein, 330 aa, Artificial Sequence
  Engineered variant of Arthrobacter transaminase
MAFSADTPEIVYTHDTGLDYITYSDYELDPANPLAGGAAWIEGAFVPPPEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGSGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 703 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtgcgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 704 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGAGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 705 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgcactaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 706 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCTTAGGVWPFVSVDGNSISDGVPGPVTQSIIRRYWELNVEPSCLLTPVQY

SEQ ID NO: 707 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggtttctcttctaccccattggagcgtgacatcaccaaacatcgtccgcaggtttacatgtatgctgttccgtacttgtttatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 708 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGFSSTPLERDITKHRPQVYMYAVPYLFIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 709 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtactgttttatcgtaccgtttgaccgcatccgtgacggtgttcacctgatggttgctcagtcagttcgtcgtacaccgcgtagctctatcgacccgcaggttaaaaacttccaggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 710 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYCFIVPFDRIRDGVHLMVAQSVRRTPRSSIDPQVKNFQAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 711 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggttcaggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgcaccaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 712 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGSGFNVVVIKDGVVRSPGRAALPGITRKTVLEIAESLGHEAILADITPAELRDADEVLGCTTAGGVWPFVSVDGNSISDGVPGPVTQSIIRRYWELNVEPSCLLTPVQY

SEQ ID NO: 713 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatctgggaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcagcgcaggtgacctgatccgtgcaattcaggaaacccacgaccgtggtttcgagttaggcctgctgctggactttgacaacctgctggctgaaggtgcgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgcaccaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 714 - protein, 330 aa, Artificial Sequence
  Engineered variant of Arthrobacter transaminase
MAFSADTPEIVYTHDTGLDYITYSDYELDPANPLAGGAAWIEGAFVPPSEARISIWDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFSAGDLIRAIQETHDRGFELGLLLDFDNLLAEGAGFNVVVIKDGVVRSPGRAALPGITRKTVLEIAESLGHEAILADITPAELRDADEVLGCTTAGGVWPFVSVDGNSISDGVPGPVTQSIIRRYWELNVEPSCLLTPVQY

SEQ ID NO: 715 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacatctgacgctacttacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgggatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 716 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVGITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 717 - DNA, 990 bp, Artificial Sequence
  Engineered variant of Arthrobacter transaminase
atggcgttctcagcggacacccctgaaatcgtttacacccacgacaccggtctggactatttaacctactctgactacgaactggacccggctaacccgctggctggtggtgctgcttggatcgaaggtgctttcgttccgccgtctgaagctcgtatctctatctgggaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgggatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgcaccaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 718 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIWDQGFYTSDATYTVFHVWNGNAFRLGDHIERLFSNAESIRLIPPLTQDEVKEIALELVAKTELREAIVWVGITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCTTAGGVWPFVSVDGNSISDGVPGPVTQSIIRRYWELNVEPSCLLTPVQY

SEQ ID NO: 719 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaggcctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 720 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELGLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 721 - DNA, 990 bp, Artificial Sequence
  Engineered variant of Arthrobacter transaminase
atggcgttctcagcggacacccctgaaatcgtttacacccacgacaccggtctggactatttaacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaggcctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 722 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELGLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 723 - DNA, 990 bp, Artificial Sequence
  Engineered variant of Arthrobacter transaminase
atggcgttctcagcggacacccctgaaatcgtttacacccacgacaccggtctggactatttaacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgggatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtgcgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 724 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVGITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGAGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 725 - DNA, 990 bp, Artificial Sequence
  Engineered variant of Arthrobacter transaminase
atggcgttctcagcggacacccctgaaatcgtttacacccacgacaccggtctggactatttaacctactctgactacgaactggacccggctaacccgctggctggtggtgctgcttggatcgaaggtgctttcgttccgccgtctgaagctcgtatctctatctgggaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaggcctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 726 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIWDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELGLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 727 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 728 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 729 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 730 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 731 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaatgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttagctctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 732 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELALLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 733 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaatgaagtaaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 734 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 735 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtcggaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccagaatgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 736 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQNEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 737 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaatgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 738 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 739 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttagctctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 740 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELALLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 741 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccggcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttagctctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgctggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 742 - protein, 330 aa, Artificial Sequence
  Engineered variant of Arthrobacter transaminase
MAFSADTPEIVYTHDTGLDYITYSDYELDPANPLAGGAAWIEGAFVPASEARISIFDQGFYTSDATYTVFHVWNGNAFRLGDHIERLWSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELALLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 743 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaatgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 744 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQNEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 745 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgcttttgttccgtcgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 746 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 747 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttcttatccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 748 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSYPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 749 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtggtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccagaatgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 750 - protein, 330 aa, Artificial Sequence
  Engineered variant of Arthrobacter transaminase
MAFSADTPEIVYTHDTGLDYITYSDYELDPANPLAGGAAWIEGAFVPWSEARISIFDQGFYTSDATYTVFHVWNGNAFRLGDHIERLFSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 751 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccagaatgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 752 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLFSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 753 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 754 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 755 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtggtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtagttctatctctgacggtgttccgggtccggttacccagtctatcatccgtcgttactgggaactgaacgttgaaccttcttgcctgctgaccccggtacagtac

SEQ ID NO: 756 - protein, 330 aa, Artificial Sequence
  Engineered variant of Arthrobacter transaminase
MAFSADTPEIVYTHDTGLDYITYSDYELDPANPLAGGAAWIEGAFVPWSEARISIFDQGFYTSDATYTVFHVWNGNAFRLGDHIERLWSNAESIRLIPPLTQDEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGSSISDGVPGPVTQSIIRRYWELNVEPSCLLTPVQY

SEQ ID NO: 757 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtcgtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccaggacgaagttaaagagatcgctctggaactggttgctaaaaccgaactgcgtgaagcgattgtttgggttgcaatcacccgtggttactcttctctgccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtcgttctatctctgacggtgttccgggtccggttacccagtctatcatccgtcgttactgggaactgaacgttgaaccttcttgcctgctgaccccggtacagtac

SEQ ID NO: 758 - protein, 330 aa, Artificial Sequence
  Engineered variant of Arthrobacter transaminase
MAFSADTPEIVYTHDTGLDYITYSDYELDPANPLAGGAAWIEGAFVPSSEARISIFDQGFYTSDATYTVFHVWNGNAFRLGDHIERLWSNAESIRLIPPLTQDEVKEIALELVAKTELREAIVWVAITRGYSSLPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGRSISDGVPGPVTQSIIRRYWELNVEPSCLLTPVQY

SEQ ID NO: 759 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgtggtctgaagctcgtatctctatcttcgaccagggtttttatacttctgacgctacctacaccgtcttccacgtttggaacggtaacgctttccgtctgggggaccacatcgaacgtctgtggtctaatgcggaatctattcgtttgatcccgccgctgacccagaatgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 760 - protein, 330 aa, Artificial Sequence
  Engineered variant of Arthrobacter transaminase
MAFSADTPEIVYTHDTGLDYITYSDYELDPANPLAGGAAWIEGAFVPWSEARISIFDQGFYTSDATYTVFHVWNGNAFRLGDHIERLWSNAESIRLIPPLTQNEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 761 - DNA, 990 bp, Artificial Sequence
  Engineered variant of Arthrobacter transaminase
atggcgttctcagcggacacccctgaaatcgtttacacccacgacaccggtctggactatttaacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 762 - protein, 330 aa, Artificial Sequence
  Engineered variant of Arthrobacter transaminase
MAFSADTPEIVYTHDTGLDYLTYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 763 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcagtaatggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 764 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFSNGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 765 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcgtcgggtgacctgatccgtgcaattcaggaaacccacgaccgtggtttcgagttaccgctgctactggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 766 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFASGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 767 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttaccattctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 768 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYHSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 769 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatgttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 770 - protein, 330 aa, Artificial Sequence
  Engineered variant of Arthrobacter transaminase
MAFSADTPEIVYTHDTGLDYITYSDYELDPANPLAGGAAWIEGAFVPPSEARISMFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 771 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatcctgatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 772 - protein, 330 aa, Artificial Sequence
  Engineered variant of Arthrobacter transaminase
MAFSADTPEIVYTHDTGLDYITYSDYELDPANPLAGGAAWIEGAFVPPSEARILIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 773 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggttcggctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 774 - protein, 330 aa, Artificial Sequence
  Engineered variant of Arthrobacter transaminase
MAFSADTPEIVYTHDTGLDYITYSDYELDPANPLAGSAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 775 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgaaggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 776 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLKDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 777 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttccggccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 778 - protein, 330 aa, Artificial Sequence
  Engineered variant of Arthrobacter transaminase
MAFSADTPEIVYTHDTGLDYITYSDYELDPANPLAGGAAWIEGAFRPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 779 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgctgcaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 780 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLLQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 781 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaccagggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctgtcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 782 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTRDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAVLADITPAELRDADEVLGCSTAGGVWPFVSVDGNSISDGVPGPVTQSIIRRYWELNVEPSCLLTPVQY

SEQ ID NO: 783 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgaggcaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 784 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLRQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 785 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttgtggagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 786 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVVEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 787 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttactgagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcggggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 788 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVTEIALELVAKTELREAIVWVAITRGYSSTPLERDITKHRPQVYMYAVPYQWIVPFDRIRDGVHLMVAQSVRRTPRSSIDPQVKNFGAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 789 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagttatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 790 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKVIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 791 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgacgccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 792 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLTPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 793 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgctgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 794 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPLLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 795 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagtttcggagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 796 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVSEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 797 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggtggaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 798 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQVEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 799 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagacggctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 800 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKETALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 801 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttctggagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 802 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVLEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 803 - DNA, 990 bp, Artificial Sequence
  Engineered variant of Arthrobacter transaminase
atggcattctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccatgacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 804 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTHDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 805 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatccgtcgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 806 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIRRLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 807 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttcttgaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 808 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFLNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 809 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgggtcaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 810 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLGQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 811 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcttgaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 812 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDILKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 813 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgtgggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 814 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRVGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 815 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttaatcgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 816 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFNRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 817 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaaccatggaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 818 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETMDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 819 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatattccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 820 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHIPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 821 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcgcgaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 822 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDIAKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 823 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgccgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaattgcgtgaagcgattgtttgggttgcaatcacccgtggttactcttctaccccattggagcgtgacgtcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 824 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDVTKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 825 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttgagctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 826 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVELMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 827 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtcttggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 828 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRLGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 829 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatgatccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 830 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHDPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

SEQ ID NO: 831 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacttgctgctggctgaaggtccgggtttcaacgttgttgttatcaaagacggtgttgttcgttctccgggtcgtgctgctctgccgggtatcacccgtaaaaccgttctggaaatcgctgaatctctgggtcaggaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 832 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDLLLAEGPGFNVVVIKDGVVRSPGRAALPGITRKTVLEIAESLGQEAILADITPAELRDADEVLGCSTAGGVWPFVSVDGNSISDGVPGPVTQSIIRRYWELNVEPSCLLTPVQY

SEQ ID NO: 833 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctcggtctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 834 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIARSLGHEAILADITPAELRDADEVLGCSTAGGVWPFVSVDGNSISDGVPGPVTQSIIRRYWELNVEPSCLLTPVQY

SEQ ID NO: 835 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggtcgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccgactgaactgcgtgatgctgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 836 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPTELRDADEVLGCSTAGGVWPFVSVDGNSISDGVPGPVTQSIIRRYWELNVEPSCLLTPVQY

SEQ ID NO: 837 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctgcctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtctttctatctctgacggtgttccgggtccggttacccagtctatcatccgtcgttactgggaactgaacgttgaaccttcttgcctgctgaccccggtacagtac

SEQ ID NO: 838 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDAAYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGLSISDGVPGPVTQSIIRRYWELNVEPSCLLTPVQY

SEQ ID NO: 839 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctgttctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 840 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAVLADITPAELRDADEVLGCSTAGGVWPFVSVDGNSISDGVPGPVTQSIIRRYWELNVEPSCLLTPVQY

SEQ ID NO: 841 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatccagcgtcgttactgggaactgaacgttgaaccttcttgcctgctgaccccggtacagtac

SEQ ID NO: 842 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIQRRYWELNVEPSCLLTPVQY

SEQ ID NO: 843 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaactatgaaccttcttgcctgctgaccccggtacagtac

SEQ ID NO: 844 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNYEPSCLLTPVQY

SEQ ID NO: 845 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgacccgtgtacagtac

SEQ ID NO: 846 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTRVQY

SEQ ID NO: 847 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagactatcatccgtcgttactgggaactgaacgttgaaccttcttgcctgctgaccccggtacagtac

SEQ ID NO: 848 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQTIIRRYWELNVEPSCLLTPVQY

SEQ ID NO: 849 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtactgttacccagtctatcatccgtcgttactgggaactgaacgttgaaccttcttgcctgctgaccccggtacagtac

SEQ ID NO: 850 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGTVTQSIIRRYWELNVEPSCLLTPVQY

SEQ ID NO: 851 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccattggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgccgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttctaatctgctgaccccggtacagtac

SEQ ID NO: 852 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPLERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSNLLTPVQY

SEQ ID NO: 853 - DNA, 990 bp, Artificial Sequence
  Engineered variant of Arthrobacter transaminase
atggcgttctcagcggacacccctgaaatcgtttacacccacgacaccggtctggactatatcacctactctgactacgaactggacccggctaacccgctggctggtggtgctgcttggatcgaaggtgctttcgttccgccgtctgaagctcgtatctctatcttcgaccagggtttttatacttctgacgctacctacaccgtcttccacgtttggaacggtaacgctttccgtctgggggaccacatcgaacgtctgttctctaatgcggaatctattcgtttgatcccgccgctgacccaggacgaagttaaagagatcgctctggaactggttgctaaaaccgaactgcgtgaagcgattgtttgggttgcaatcacccgtggttactcttctaccccaatggagcgtgacatcaccaaacatcgtccgcaggtttacatgtatgctgttccgtaccagtggatcgtaccgtttgaccgcatccgtgacggtgttcacctgatggttgctcagtcagttcgtcgtacaccgcgtagctctatcgacccgcaggttaaaaacttcgcggcaggtgacctgatccgtgcaattcaggaaacccacgaccgtggtttcgagttaccgctgctgctggactttgacaacctgctggctgaaggtccgggtttcaacgttgttgttatcaaagacggtgttgttcgttctccgggtcgtgctgctctgccgggtatcacccgtaaaaccgttctggaaatcgctgaatctctgggtcacgaagctatcctggctgacatcaccccggctgaactgcgtgatgccgacgaagttctgggttgctcaaccgcgggtggtgtttggccgttcgtttctgttgacggtaactctatctctgacggtgttccgggtccggttacccagtctatcatccgtcgttactgggaactgaacgttgaaccttcttgcctgctgaccccggtacagtac

SEQ ID NO: 854 - protein, 330 aa, Artificial Sequence
  Engineered variant of Arthrobacter transaminase
MAFSADTPEIVYTHDTGLDYITYSDYELDPANPLAGGAAWIEGAFVPPSEARISIFDQGFYTSDATYTVFHVWNGNAFRLGDHIERLFSNAESIRLIPPLTQDEVKEIALELVAKTELREAIVWVAITRGYSSTPMERDITKHRPQVYMYAVPYQWIVPFDRIRDGVHLMVAQSVRRTPRSSIDPQVKNFAAGDLIRAIQETHDRGFELPLLLDFDNLLAEGPGFNVVVIKDGVVRSPGRAALPGITRKTVLEIAESLGHEAILADITPAELRDADEVLGCSTAGGVWPFVSVDGNSISDGVPGPVTQSIIRRYWELNVEPSCLLTPVQY

What is claimed is:

1. An engineered transaminase polypeptide comprising an amino acid sequence having at least 80% sequence identity to reference sequence SEQ ID NO:4 and at least an amino acid residue difference as compared to SEQ ID NO:4 at residue position X192, and the substitution X136L.

2. The engineered polypeptide of claim 1, in which X192 is selected from A, G, H, K, N, Q, R, and S.

3. The engineered polypeptide of claim 2, in which the amino acid sequence further comprises one or more residue differences as compared to SEQ ID NO:4 selected from: X2M; X4F, X4L, X4Y; X5C, X5F, X5I, X5H, X5K, X5L, X5M, X5N, X5P, X5S, X5T, X5V, X5Y; X6F, X6R, X6S, X6T; X8H; X9L, X9I, X9Q, X9F; X1OL; X12H; X13A, X13F; X17L; X18I; X21L; X22A, X22H; X25A; X27L, X27H, X27P; X28N; X29N, X29T; X30F, X30G; X31H, X31R; X34V; X37S; X42G; X43S; X46R; X47R; X48A, X48G, X48R, X48S, X48W; X49I, X49P; X50S; X52H; X54A, X54L, X54M, X54P, X54R; X55M; X56D, X56E, X56W; X61G; X61W; X62A, X62L, X62N, X62S; X64C; X66A, X66S; X68I; X69A, X69G, X69T; X72A; X80Q; X81K; X84T; X85L, X85R; X88W; X89L; X97P, X97T; X99L; X101G, X101L, X101R; X102H, X102R; X102T, X102W; X103G, X103N, X103V; X106L, X106S, X106T, X106V; X107T; X108T; X115R; X117V; X120F; X122F, X122M, X122W, X122Y; X124F, X124K, X124L, X124M, X124N, X124R, X124S, X124W; X126A, X126C, X126G, X126I, X126T; X127T; X128A; X131F; X132H; X134G, X134L, X134S, X134V, X134Y, X134W; X139E; X140A, X140K; X140M, X140T, X140V; X141A; X142M; X143V; X144D, X144I; X146R; X150L, X150S; X152A, X152C, X152F, X152G, X152I, X152L, X152R, X152S, X152W; X155C, X155I, X155L, X155T; X156A, X156F, X156S, X156T; X157L; X159G; X160L; X161M, X161N; X165L, X165N, X165V; X168E, X168R; X176C; X179K; X185A; X190M; X191A, X191G, X191S; X196L, X196V; X199L, X199V; X203M; X208K; X209F, X209M, X209Q, X209V; X210G, X210S; X215F, X215H, X215L; X217L; X223A, X223S, X223T, X223V; X227I; X231T; X233D; X234L; X241R; X256R; X260Q; X263V; X265Y, X265W; X266N; X267V; X269L, X269T; X270R, X270T; X273D, X273H, X273M, X273R, X273V; X274F, X274L, X274R, X274T; X282I, X282L, X282T, X282V; X284A, X284P, X284S, X284T, X284V; X295N, X295S; X296D, X296L, X296R, X296S, X296W; X297D; X297G; X300G, X300L; X305Q, X305T; X308A; X309L, X309T, X309W; X311Q, X311T; X312C, X312M; X316L, X316R; X319R, X319T, X319Y; X320G, X320Q; X323C, X323E, X323N, X323R; X324Q; X325M, X325P, X325Q, X325V; X327L, X327R; and X329P.

4. The engineered polypeptide of claim 1, wherein the amino acid sequence further comprises a combination of residue differences selected from:
(a) X192A/X192S and X215H;
(b) X124W, X126A, and X192A/X192N/X192S;
(c) X124W, X126A, X152L/X152W/X152I, and X192A;
(d) X54L, X124W, X126A, X192A, X215H, and X223S;
(e) X54L, X64C, X124W, X126A, X192A, and X215H;
(f) X124W, X126A, X140K, X150S, X155I, X192A, X196L, X215H, and X227I;
(g) X54L, X124W, X126A, X155I, X156T, X157L, X192A, X215H, and X223S;
(h) X54P, X64C, X124W, X126A, X155I, X156T, X157L, X192A, and X215H;
(i) X124W, X126A, X143V, X150S, X156T, X159G, X192A, X215H, X223S, and X227I;
(j) X54P, X56E, X64C, X124W, X126A, X139E, X140K, X143V, X150S, X156T, X192A, and X215H; and
(k) X124W, X126A, X140K, X143V, X155I, X156T, X157L, X192A, X199V, X215H, X223S, X227I, and X231T.

5. The engineered polypeptide of claim 1, in which the amino acid sequence further comprises residue differences selected from:
(a) X192A;
(b) X124L and X192A;
(c) X124W, X126A, X192A, and X284A;
(d) X122W, X124F, X126A, X192A and X284V;
(e) X124W, X126A, X143V, X150S, X156T, X159G, X192A, X215H, X223S, and V227I; and
(f) X54P, X64C, X124W, X126A, X139E, X143V, X155I, X157L, X159G, X192A, X199V, X215H and X227I.

6. The engineered polypeptide of claim 1, in which the amino acid sequence comprises SEQ ID NO:824.

7. The engineered polypeptide of claim 1, capable of converting compound 2 to compound 1,

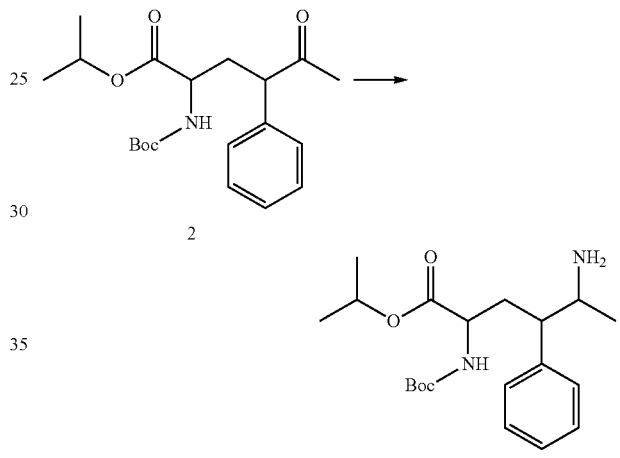

under suitable reaction conditions.

8. The engineered polypeptide of claim 1, capable of converting compound 2 to compound 1d and compound 1a

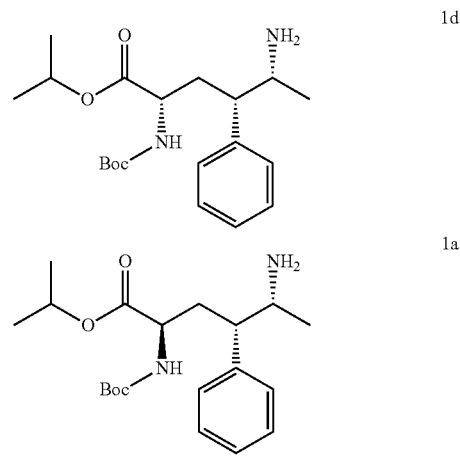

with at least 1.5 fold the activity of SEQ ID NO:4 under suitable reaction conditions.

9. The engineered polypeptide of claim 8, in which the amino acid sequence further comprises at least one or more residue differences as compared to SEQ ID NO:4 selected from: X54A; X54L; X56D; X56E; X61G; X61W; X62A; X62L; X62N; X62S; X64C; X68I; X122F, X122W; X122Y; X124K; X124M; X124S; X124W; X126C; X126I; X139E; X140K; X143V; X150L; X155I; X155L; X159G; X160L; X176C; X192A; X192G; X192H; X192K; X192N; X192Q; X192R; X192S; X199L; X199V; X209F; X209M; X209Q; X209V; X223S; X223T; X223V; X227I; X282L, X282V; X284A; X284P; X284S; X284T; and X284V.

10. The engineered polypeptide of claim 1, capable of converting compound 2 to compound 1d and compound 1a

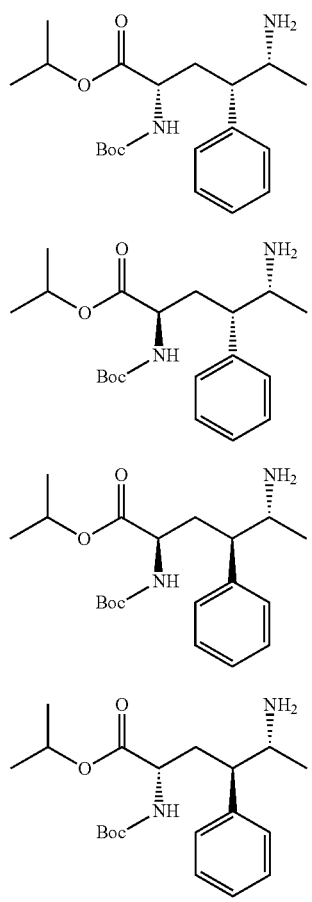

in a diastereomeric ratio greater than 8:1 over compound 1b and compound 1c.

11. The engineered polypeptide of claim 10, in which the amino acid sequence further comprises one or more residue differences as compared to SEQ ID NO:4 selected from: X62N, X62A, X62S; X62L; X124W; X124F; X124K; X124L; X124M; X124N; X124R; X124S; X136Y; X152A; X152C; X152F; X152G; X152I; X152L; X152R; X152S; X152W; X192A; X192G; X192H; X192K; X192N; X192Q; X192R; X192S; X215H; X215L; X284V; X284A; X284P; X284S and X284T.

12. A polynucleotide encoding the engineered polypeptide of claim 1.

13. A polynucleotide comprising SEQ ID NO:823.

14. An expression vector comprising the polynucleotide of claim 12.

15. The expression vector of claim 14, comprising a control sequence.

16. A host cell comprising the polynucleotide of claim 12.

17. A method of preparing a transaminase polypeptide, comprising culturing the host cell of claim 16, under conditions suitable for expression of the polypeptide.

18. The method of claim 17, further comprising isolating the polypeptide.

19. A process for preparing a compound of formula I,

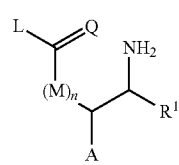

wherein
L is a leaving group;
A is an optionally substituted cycloalkyl, heterocycloalkyl, aryl, heteroaryl, fused aryl, or fused heteroaryl;
$R^1$ is H or an optionally substituted $(C_1-C_6)$ alkyl;
Q is O or S;
M is —$CR^aR^b$—, wherein each M is independent of the other and $R^a$ and $R^b$ are selected from H, halo, —$OR^3$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, aryl, heteroaryl, and a protecting group; and
n is an integer from 0 to 4,
comprising contacting a substrate compound of formula II,

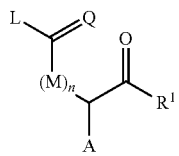

wherein L, A, $R^1$, Q, M and n are defined above, with a transaminase polypeptide of claim 1, in the presence of an amino donor under suitable reaction conditions.

20. The process of claim 19, wherein L is selected from: Cl, Br, —$OR^f$, —$OC(O)R^f$, —$SR^f$, and —$OPO_3$, wherein each $R^f$ is, independently of the others, selected from $(C_1-C_6)$alkyl or aryl.

21. The process of claim 19, in which L is —$OR^f$, wherein $R^f$ is selected from an optionally substituted methyl, ethyl, n-propyl, isopropyl, -butyl, iso-butyl, sec-butyl, and tert-butyl.

22. The process of claim 19, wherein A is selected from an optionally substituted phenyl, pyridinyl, indolyl, and napthyl.

23. The process of claim 19, wherein $R^1$ is an optionally substituted $(C_1-C_6)$alkyl.

24. The process of claim 19, wherein $R^a$ and $R^b$ are selected from H and —$NR^dR^e$.

25. The process of claim 19, in which A has one or more substitutions selected from —$OR^g$, —COOH, —$SO_2$, —SR$^h$, —NR$^i$R$^j$, —NO$_2$, —CN, halo, alkyl, and aryl, wherein R$^g$, R$^h$, R$^i$ and Rj are selected from H and (C$_1$-C$_6$) alkyl.

26. The process of claim 19, in which the protecting group is selected from tert-butyloxycarbonyl (Boc), 9-fluorenylmethyloxycarbonyl (Fmoc), trichloroethyl chloroformate (Troc), p-methoxybenzyl carbonyl (Moz), 3,4-dimethoxybenzyl (DMPM), p-methoxybenzyl (Pmb), tosyl (Ts) and carbobenzyloxy (Cbz).

27. The process of claim 19, in which n is 2 or 3.

28. The process of claim 19, wherein the substrate compound of formula II comprises the compound of formula 2p

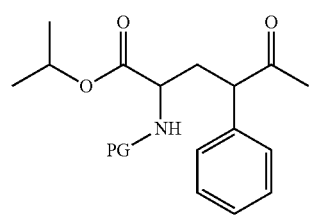

2p wherein PG is a protecting group, to produce the compound of formula 1p

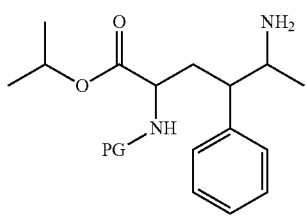

1p

29. A process for preparing compound 1d1 and compound 1a1

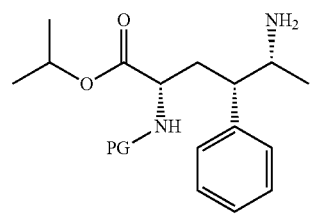

1d1

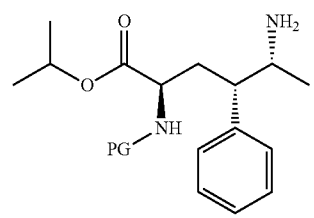

1a1

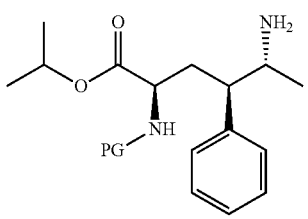

1b1

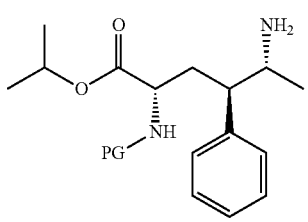

1c1 wherein PG is a protecting group, in diastereomeric ratio greater than 8:1 over compound 1b1 and compound 1c1, comprising contacting a substrate compound 2p,

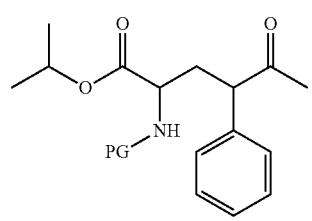

2p with a transaminase polypeptide of claim 1, in the presence of an amino donor under suitable reaction conditions.

30. The process of claim 19, in which the substrate compound is at a loading of 0.5 to 200 g/L.

31. The process of claim 30, in which the substrate compound is at a loading selected from 0.5, 1, 5, 10, 20, 30, 40, 50, 100, 150, and 200 g/L.

32. The process of claim 19, in which the suitable reaction conditions comprise a DMSO concentration of 1% to 80% (v/v).

33. The process of claim 32, in which the amino donor is isopropylamine.

34. The process of claim 33, in which the isopropylamine is at a concentration of 0.1 to 3.0 M.

35. The process of claim 19, in which the suitable reaction conditions comprise (a) substrate loading of about 10 to 100 g/L substrate compound; (b) transaminase polypeptide concentration of about 1 to 40 g/L; (c) IPM concentration of about 0.1 to 10 M; (d) PLP cofactor concentration of about 0.1 to 1 mM; (e) pH of about 8.5 to 11; and (f) temperature of about 30 to 60° C.

36. The process of claim 19, in which the suitable reaction condition comprises: about 50 g/L substrate compound, about 20 g/L or less of transaminase polypeptide, about 50% (v/v) dimethylsulfoxide (DMSO), about 1 M isopropylamine (IPM), about 1 mM pyridoxal phosphate (PLP), about 0.2 M borate, about pH 10.5 and about 55° C.

37. A process for preparing the compound of formula III

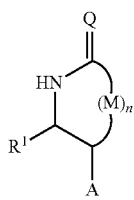

wherein,
A is an optionally substituted cycloalkyl, heterocycloalkyl, aryl, heteroaryl, fused aryl, or fused heteroaryl;
$R^1$ is H or an optionally substituted $(C_1-C_6)$ alkyl;
Q is O or S;
M is —$CR^aR^b$—, wherein each M is independent of the other and $R^a$ and $R^b$ are selected from H, halo, —$OR^c$, —$SR^c$, —CN, —$NO_2$, —$NR^dR^e$, alkyl, alkenyl, alkynyl, arylalkyl, arylalkenyl, arylalkynyl, heteroarylalkyl, heteroarylalkenyl, heteroarylalkynyl, cycloalkylalkyl, cycloalkylalkenyl, cycloalkylalkynyl, heterocycloalkylalkyl, heterocycloalkylalkenyl, and heterocycloalkylalkynyl, wherein $R^c$ is selected from H, alkyl, cycloalkyl, heterocycloalkyl, aryl, and heteroaryl, and $R^d$ and $R^e$ are selected from H, alkyl, cycloalkyl, heterocycloalkyl, cycloalkylalkyl, heterocycloalkylalkyl, aryl, heteroaryl, arylalkyl, heteroarylalkyl and a protecting group; and
n is an integer from 0 to 4,
comprising (a) carrying out the process of claim 19, to prepare the compound of formula I, and (b) cyclizing the compound of formula I.

38. The process of claim 37, in which the compound of formula III comprises compound 3p,

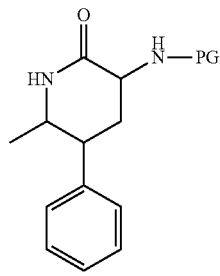

wherein PG is a protecting group, the process comprising (a) carrying out the process of claim 28 for preparing compound 1p and (b) cyclizing the compound 1p.

39. The process of claim 37, in which the compound of formula III comprises compound 3d1 and compound 3a1

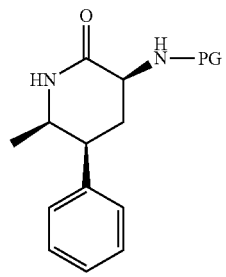

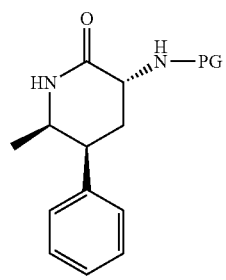

wherein compound 3d1 and compound 3a1 is produced in diastereomeric ratio greater than 8:1 over compound 3b1 and compound 3c1,

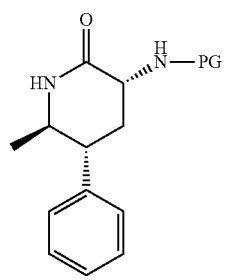

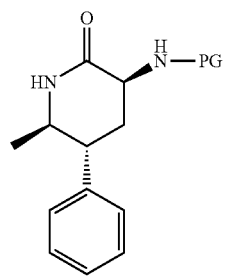

the process comprising (a) carrying out the process of claim 29, and (b) cyclizing the products of step (a).

* * * * *

UNITED STATES PATENT AND TRADEMARK OFFICE
CERTIFICATE OF CORRECTION

PATENT NO. : 9,109,209 B2
APPLICATION NO. : 14/342713
DATED : August 18, 2015
INVENTOR(S) : Cabirol et al.

Page 1 of 1

It is certified that error appears in the above-identified patent and that said Letters Patent is hereby corrected as shown below:

IN THE CLAIMS

In Claim 3, column 115, line 14, please replace "X1OL" with "X10L";
In Claim 3, column 115, line 15, please replace "X181" with "X18I";
In Claim 19, column 118, line 27, please replace "-OR$^3$" with "-OR$^c$"; and
In Claim 25, column 119, line 2, please replace "Rj" with "R$^j$".

Signed and Sealed this
Sixteenth Day of February, 2016

Michelle K. Lee
*Director of the United States Patent and Trademark Office*